United States Patent 11,098,302 (IDENTIFICATION OF POLYNUCLEOTIDES ASSOCIATED WITH A SAMPLE) - sequence listing, part 6

SEQ ID NO: 16603 - DNA, 564 bp, Homo sapiens
  misc_feature: GYAE6OF02HM7BQ.22.65.F10.1.454.CMB.1.raw
  modified_base (273)..(273): a, c, t, g, unknown or other
  misc_feature (273)..(273): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagctctggattccccttnagtgacttctacatgaattggatccgccaggctaccgagggaaggggctggaggtgggtttcatacattagtggtagtggtatttttaaanacgtnagactctgtgaagggcattcacatctccagggacaacgcaagaactcatgtatntgacaaatgaaacngcctgaggagtcggagacgacggcgttaggtatttagttgtggacggggaagagggctcggggacgtaagtttactggtccgtttaccggaccccgttgggggacccgacggggtaaccccttcggg

SEQ ID NO: 16604 - DNA, 707 bp, Homo sapiens
  misc_feature: GYAE6OF02H1TIV.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggcgtcgtggggggagtcgttgggtcaaggccgtgggacgggtccctaggacgacctctccgtgtcggacacgtcctcgtggtacctttccccctgtagtcgacctttcactatagtaattggactccgaccaggcctaccggaaggggacgggtctgggtagtggttacaatcgagttacggtggtagttggttaattttaaagcgcgagtctgtgtagaacgggtcctatacacgtatcctacgaggaaccacgacaagactacgactgtactctacgtaacaaatcgtaaacacgtaccgtagaacggtaacggtccgaacgggtaccgaccgggttaccgttacggttaagttaacgtttacgggagggtaccgggggtaaaggtaacggggtacggttaccggggtacgtaaggttttaacgtccggtttacccggtttaaccccgggaccccgggttacggggggtaaccccgtacccggggtaacccgttacccgggg

SEQ ID NO: 16605 - DNA, 563 bp, Homo sapiens
  misc_feature: GYAE6OF02I6N98.22.65.F10.1.454.CMB.1.raw
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagacatacgcgtcacgaccggtgctcgatttagctacgctctaaggggagctctgggagaagagccccagccccagaattcccaggagtttccgttcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgccaggctccgagggaaggggctggagtgggttcagtacattagtggtagtggttattttaaatacgtcagtactcgtgtgaagggccgattcacctatctcgaggacaacgccaagactcactgtanctgacaatgaacngacctgagngtacgaggacacgggtccgtgtattatggtgacggggtagaggtagtcgggctaggttacgtgtccgtttcccggaccccgttggggacccgacgggtacccctgggtaccccg

SEQ ID NO: 16606 - DNA, 757 bp, Homo sapiens
  misc_feature: GYAE6OF02IG3N9.22.65.F10.1.454.CMB.1.raw
tcagacatacgcgtcacgaccggtgctcgatttagctacgctctaagggaggctctgggagaagagcccagccccagaattcccaggacgtttccattcggtgatcagcactgaacacagaggactcaccatggagtttggctgagctggttttccttgttgctattataaaggtgtccagtgtcaggtgcagctggtggcgtcgtggggggagtcgttggtcaaggcctggggacgggttccctagggacgtaccgttccgtccgtggtcgacacgtccttcgtggacctttccccgtttacgagttcgtacctttcaacctagttgtaagtttcggacttcccgccgagggcctccggaggggaacggggctggggagttgggtttcagtacgtagttaggtggttacgttaggttaattttaaacgtacgctaaacggtactcgtggtaacgaacggggtcctagttaccgactaatcgtaccgacgggtaacctaacgacccgtaaagtaacctcgtaacgttcggtaacttacggtacgtaaccaaaaggttacgaaacgtcggacctagggtaacgaacgttaccgggaacgtaacccgggacgggtacccttaggttaaataacggtttcggtagggaccggggttaaaggacggtacggttacgggacgttaacggttttaacgtggttacccggtttaccggacccccgggtttgggggaaccccgtacgggggtaaccccgttcggg

SEQ ID NO: 16607 - DNA, 713 bp, Homo sapiens
  misc_feature: GYAE6OF02H66ZR.22.65.F10.1.454.CMB.1.raw
  modified_base (280)..(280): a, c, t, g, unknown or other
  misc_feature (280)..(280): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagttgggctgagctgggttttccttgttgctattataaaaggtgtccagtgtcaggtgcagctggtggcgtcgtgggggaggcttggtcaaggcctgggagggtccctggagacctctcctgtgcagcctctggacttccccttnagtgacttctacactgaattggactccgccaggcctccgagggaaggggcgtagggtaggtgggttacagtacagttaggttggtaagtgggttaattttttaagacgtcaagtacgtctggtagaacggggccgtattccgacctaatctaccggtacgggaaccaaaccgaccaaaggaactactaacgtgttaactcgtagactaaaagtaccgaaacgacgacctaggaacggtaacggttacggaacgggtacccgaaccgggtaccgttacggttaaagtttaacgtttgggtagggaccggggtaaacggggtaacgggacgggtaccggggtacgaacgggttttaagtccggtttaccgtttacccgggaacccccgggttcgggggaccccggttaacccgggggtaccccgttacccggggg

SEQ ID NO: 16608 - DNA, 632 bp, Homo sapiens
  misc_feature: GYAE6OF02H0PRJ.22.65.F10.1.454.CMB.1.raw
  modified_base (373)..(373): a, c, t, g, unknown or other
  misc_feature (373)..(373): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggaggcttgggtcaagcctggagggtccctgagactctcctgtgcagcctctggtacttccccctcagtgacttctacatgaattggactccgccaggctccgagggagggctgggagttgggttacatacagttagtggtagttggttaatttttaaanacgtctagactcgtggtaggaagggccgtattcacctagtcctccgagggacaaccgaccgaaagaacctcacttgtaacttctagacaaagtgaaacacgacctagagacgtacggaggtaaccgcgggtacgttgtaagttacgttggtacggacgggaaggacgggtaagtccgggtagttaaggttacgtcggttacccgttttaccgggacccccggttaggggggacccgtacggggtaaccccgttaccggg

SEQ ID NO: 16609 - DNA, 873 bp, Homo sapiens
  misc_feature: GYAE6OF02HSFJZ.22.65.F10.1.454.CMB.1.raw
  modified_base (284)..(284): a, c, t, g, unknown or other
  misc_feature (284)..(284): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggtttccttgttgctattataaaaggtgtccagtgtcaggtgcagctggtggcgtgtggggggagtcgttgggtcaagccgtggacgggtcctgagactctcctgtgcagcctcgtcggtactttcccccttnaacgtcggtaacctttctaactattagaaagtttgggaacttcccgaccgacggtcctcccggaaggggtaacggggctaggggtaaggttcggggtttaccaagtaacgtaagttaaggttagggttaagtttggggttaaacttttttaaaagacggtaccgtaagtaaccgttcgtaggttaacgggaaacgggggtccttaacggttaccctaacccgtaagttaaccgttaccggtaaacggggaacctaaaaccggtacccgaaaaggtaaacctaccgtaactacggtttaactaccgtacggtaaacctaaaagttaccgaaaacgtacggtaacccgttaagggaacggtaaacggtttaccgggaaacgggtaacccggtaaccggttacccgggttaaggtttaaactttaaagggtttcgggggttaaccgggtacggggggaaaacggtttacggggaaacggttttccccgggggaagtttaaggtttaaacgtccgggttaacccgttttcccgggtaacccccggttacggggggtaaccccgtaacccgggggttaacccctttacccgggg

SEQ ID NO: 16610 - DNA, 778 bp, Homo sapiens
  misc_feature: GYAE6OF02IWJAN.22.65.F10.1.454.CMB.1.raw
  modified_base (252)..(252): a, c, t, g, unknown or other
  misc_feature (252)..(252): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgttgctattataaaaggtgtccagtgtcaggtgcagctggtggcggtcgtgggggagcttggtcagctgggaggtccctgagactctcctgtncagccgtctggacttcccccttcgagttcgtacttctaaccagtacgtaattgggaatcccggcccagggtcctaccggaaggggaacgggggtccgtaggggtaacggttggggttttaccaacgttaaccgtaagtttaaggttgggttaaggtttagggttaaagtttttttaaaacgtacgtaccgtaaaggtaccgttacgttggtacggtaaacggggtccgtaacgtttaaccaccgtaacgtcccgtacccgaacggggtaaccaaaccggacccgtaaagtaaccgtaccaaccgttagtacgttccgttagaactaaagtacgaacgacgtacgtaggaggtacgtacggaacgggaaccgtaccgggacccggttagttacttaacgttggttacgggacggggtaaacggacggtaacgggttccgggacgttaacggttacgttccggttacccggttaccgggtacccccggtacgggggaccggtaaccgggggtaaccccgttaccgggg

SEQ ID NO: 16611 - DNA, 753 bp, Homo sapiens
  misc_feature: GYAE6OF02JZ325.22.65.F10.1.454.CMB.1.raw
  modified_base (279)..(279): a, c, t, g, unknown or other
  misc_feature (279)..(279): n is a, c, g, or t
tcagacatacgcgtcacgaccggtgctcgatttagctacgctctaaggggagctctgggagaagagccccagccccagaattccccaggagtttccattcggtgatcagcactgaacacagaggactcaccatggagtttgggctgagctgggttttcctgttgctattataaaggtgtccagtgtcaggtgcagctggtggcgtcgtgggggagcttggtcaagccgtgggagggtccctggagacctctccgtgtgcagcctctggacttccccttnagtcgacttactcatgtaatggactcgccaggctccgagggaggcgtggaggtcggttcatacgagttacggtggtacgttaggttaatttttaaagtacggtatacgtacgtacgtaggttaggaacgggtccggtaaacttccgtaaccctagttacccggtaccggaaaccggggtaaccgtaaaccgtacccgtaaaagaaaccgttccgaaaccttgtaccgtactacgggtaaaccaaaacgttcgaaaaccgccgtaaccggtacgtaaggacgtaccggggtaacgaaaccgggtccgggttaaccggttagttaagtttacgggttacggtaggggtaaccggggaggtttaacggggaaccggttacgggggtactaaaggttttaccggttaacgttacccgggttaaccccgggtacccggttacggggggaccccgtaacggggttaccccgttacccggg

SEQ ID NO: 16612 - DNA, 639 bp, Homo sapiens
  misc_feature: GYAE6OF02JCXQY.22.65.F10.1.454.CMB.1.raw
  modified_base (275)..(275): a, c, t, g, unknown or other
  misc_feature (275)..(275): n is a, c, g, or t
  modified_base (373)..(373): a, c, t, g, unknown or other
  misc_feature (373)..(373): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttagtcaagcctggaggtccctgagactcctcctgtgcagcctctggtacttccccttnagtgtacttctacatgaattggactccgccaggctccgagggacgggctggagtgggtttcattacattaggtggttagttaggttaatttttaaaancgtactagtacttcgtggtacggaacggggtccgtatttccgaaccctatcctacccgaagggaactaaccggaccaaacgaactaccactagtactcgtagactaaatacgaacacgccgtagagtagtacggagaccgacggtccgttgttaatttagttggtcggacgggtaaggagggtaaggtacggggtacgtaaggttacgtcggttaccgtttcccggtaccccggtcggggtacccgtacggggtaccccgtccggg

SEQ ID NO: 16613 - DNA, 591 bp, Homo sapiens
  misc_feature: GYAE6OF02GB5CE.22.65.F10.1.454.CMB.1.raw
  modified_base (398)..(398): a, c, t, g, unknown or other
  misc_feature (398)..(398): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggaggtccctgagactctcctgtgcagcctctggacttccccttcacgtgacttctacatagaattggactccgccaggcctccgaggggaaggggcgtgggagtgggtttcatacagttaggtggtagttggttaatttttaatacgtcagtactctgtgaagggcgtntcacagtctacgaggacacgccaaacgactcactgtactctagacaatagaacagacctagagacgtacgaggaccgcggccgtagtattacgttgaggtacggaaggacgggtacgtcgggtacgtaggtttacgtacgttccgttacccggtaccccggttcggggacccgtacgggaccccgttaccggg

SEQ ID NO: 16614 - DNA, 566 bp, Homo sapiens
  misc_feature: GYAE6OF02H1CF5.22.65.F10.1.454.CMB.1.raw
  modified_base (379)..(379): a, c, t, g, unknown or other
  misc_feature (379)..(379): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagccgtggagggtccctgacgactctcctgtgcagcctctggattccccttcagtgacttctacatgaaattggatccgccaggctccgagggaaggggctgggagtggggtttcatacatttagtggttagtggtattttttaaaagtacgtnagactctgtgaaggccgtattcacctatctccagggacaacgccaagaactacactgtatctgcaaatnaacngcctgagagtcgaggacagggaccgtgtattagttgtagcgggaagagggagtccgggacgaggttattgccttttcggaccccgttggggacccgagggtaacccgttccggg

SEQ ID NO: 16615 - DNA, 674 bp, Homo sapiens
  misc_feature: GYAE6OF02JH2Z7.22.65.F10.1.454.CMB.1.raw
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttggtcaagccgtgggagggtccctgagactctcctgtgcagcctntggactttccccttacngtcgtacttctacatgaattggatccgcnggctcgaggggaggctgggagttgggttnatacgtattaggtggtaggttggttaatttttaaagacgngtagtacttcgttaggtacgaacggggccgtattccacgtactccgtacccgtaaggggaacctaacccggaccaaacggtaacctacgtaacgtacgtacttccgacgtaactaaagtacgaactacgtccgtagaacggtacggtaccggacggtaaccgaccggtacggttagttaacgttagttcgggtacgggacggggtaaggaggggtacggtccgggtagtaaggtttacgtcggttccgtttacccggcccgggttacggggaccggtacccgggtaccgttaccggg

SEQ ID NO: 16616 - DNA, 641 bp, Homo sapiens
  misc_feature: GYAE6OF02JUY2E.22.65.F10.1.454.CMB.1.raw
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtgggtttcttgtgctattataaaggtgtcagtgtcgaggtgcagctggtggcgtcgtgggggagtctggtcaagtcctgggaggtccctgagctcgtcctgtcgcacggtcctctacggtcttccccttctagtcgtaccttctacatagtaacgttcggcgttccgccgacggccttaccggagggaaggggccgtgggtacggttgggttctagtacgtagttagtggttaggttagtacgtttttaaanctacgtaagtcgtntaggtagaacgggtccgattacacgtctacgtcgaacgacctaacgacaagaccgtacactagtaacgtcgtaacgtactaaagttacacttacggacctttaggacggttagaccggtacggtacgaccggttacgtaggttacttaggttcgtacggaggtaagacgggtcggtagcgtaagttcgtaggtcccttggccgttacggcggtaccgtacggtcgg

SEQ ID NO: 16617 - DNA, 811 bp, Homo sapiens
  misc_feature: GYAE6OF02JKKGF.22.65.F10.1.454.CMB.1.raw
tcagacatacgcgtcacgaccggtgctcgatttagctacgctctaaggggagctctgggagaagagcccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggaggtcttggtcaacggtccgtgggacgggtccctagacggaccttcgtcccgtggtcgaccacggcccttcgtcgggtacctttccccctttcgaacgttcgtacctttctaaccgtagtaggtaagtttcgggacgttccccggaccgacgggtccgtacccggaaaggggtaacggggcgttggggaagggtttcggggttttaccgagttacgtaagtttagggtacgggttaaggtttagggtttaaacttttttaaacgtaccgggtactaaggtactttcggttaggtaacggaacgggtaccgttaactttccgaacccgttaacttcccgtaaccggaccgggtaaacaacccggacccgtaaaacggtaccgttaccgaacgtttagtacttccgttacgaacgtaaactacggaacgtaacggcctaggaacggtacggtaccggacgggaaccgtccgggtacgttagttacgttaagttaggggtacgacgggggtaagaggtacgggtacgggtacggtaacgttagttaccgttccggttaccggtaccccggtaggggacccgttacggggtaccccttacggg

SEQ ID NO: 16618 - DNA, 738 bp, Homo sapiens
  misc_feature: GYAE6OF02II9OT.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgcagctggtggcgtcgtgggggagcttggtcaagcctggaggtccctgagtactctctgtcgcagcctctggtacttccccttcagtgtacttctacatgtaatttggacgtccgccgaacggccgtaccgaaggggtacggggcgtgggtaggttggggtttcacttactagtttacggtggttaaggttaggttaaagttttttaaaatacggtacgtaagtacttcgtaggttagaacggggtacctacttaccgaccgtaactaccgtaccgtaacgggaaccaaaccggtaccaaaggtaacctacggtacctaagtacttacgttagaacgtaaaacgtagaaccgtacgtaccgtaggtaaggtaacggttacgaaacggaccgttaaccggggcccgttttaggtaaactttaggttacggttaacggaggggaacggagggtaccggttaaccgggtcgttaagtttacgtaggtttacccgtttacccgggaccccggttagggggaaccctaccggggtaaccccgttaccgg

SEQ ID NO: 16619 - DNA, 610 bp, Homo sapiens
  misc_feature: GYAE6OF02GAZZV.22.65.F10.1.454.CMB.1.raw
  modified_base (275)..(275): a, c, t, g, unknown or other
  misc_feature (275)..(275): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagcgtggtggcgtctgggggagcttggtcaagcctggagggtccctgagactctcctgtgcagcctctggacttccccttnagtgacttctacatgaattggatccgccaggcctccgaggggacggggctgggaggttgggtttcagtacagttagtggtagttggttaatttttaaancgtcagacttntgtgaaggccgtattcacatctaccgaggacaacgcaagaacctcactcgtactcgtagacaaagtgaacagacctagaagacggtacggaggaccgtaccgggtccgttaggttatttacgtcggtagggacgggtaaggagggtacggtacgggtacgtaggttagtacggttccgtttacccggacccggttacggggacccgtacggggtacccgttcggg

SEQ ID NO: 16620 - DNA, 742 bp, Homo sapiens
  misc_feature: GYAE6OF02GFY3R.22.65.F10.1.454.CMB.1.raw
  modified_base (277)..(277): a, c, t, g, unknown or other
  misc_feature (277)..(277): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgcagctggtggcgtcgtgggggagtcttggtcaagcctgggaggtccctgacgactctccgtgtgcagcctgtggacttccccttnagttcgacttctacagtagaagttggactccgaccaggcctaccggaggggaacgggtctgggtaggttgggtttacacgttacgtagtttaggtacggttaggttaggtttaattttttaaacgaccggtactacgtaacgttcgtaggtacgggaacgggtaccgtattaccgacctacttcccgtaccgacgggaaccaaccggaccgaaacgtaccgtactaaccgttagtacttaccgtacgactaaacgtacaacgacgtaccgtaggaacgacgggtacgaacgggaacccacgggttccgttagttaacgtttaggtcggttaacggggacgggtaaaggtacgggtaaggttaccggggtaacttaacggtttacggttaccggttacccggttttaccccgggaccccgggttaccgggggaccccggttaacggggtacccccggtttaccggg

SEQ ID NO: 16621 - DNA, 748 bp, Homo sapiens
  misc_feature: GYAE6OF02GAIEN.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagctggtggcgtctggggggaggcgttggtcaagcctgggagggtccctgagactctcctgtcgcagcctctggacttccccttcagtgacttcctacatgtaacttggtactccgccacggtcctaccgaggggaagggggctgggtaggttgggtttacgactactattaggtggtaggttaggttaatttttaaatacggtcgtaagtacttcgtaggtaggaacggggcccgtatttaccaaccgtaacgttccgtacccgacggggaacctaaaccggacccgaaacgaaaccttaccgaaccgttagttaacttacgttacgtactaaaattacgaaacctacgacccttagaacgtaggtacggaacggaccgtaacgggtaccgttacggttaacttttaacgttgggtttaacgggaccggggtaaagggtaacgggtacggtacgggggtaccgtaacggtttaagttcgggttaccgttttaccccgggaacccccgggttccgggggtaccggtaaccgggggtaaccccgttacccgggg

SEQ ID NO: 16622 - DNA, 929 bp, Homo sapiens
  misc_feature: GYAE6OF02HTRYB.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggaggcttggtacaagccgtgggacggtccctggacgactctccgtgtcgcacgccttcgtggtactttccccttacgtaggtcgtacctttctaaccgtagttagtaagtttcggaacttccccggaccgtaacgggtccgttacccgggaagggggtaacggggggccgttaggggtacgggtttacgggggttttacaacggttaaccgtaaggttttaggttacggggttaaggttagggttttaaaatttttttaaaacggacggtaccgtaaacggttaaccttaccggttaggttaacgggaaacggggtacccggttaacgtttacccgaacccgtaacgtttacccgttaaccccggtaaagggggtaaacccctaaacccgggtaaacccggtaaaacggttaaacccttaaccggtaaaccgttacgggtttaaaccttccggttaaacggtaaacttaaaaacggttaccgggaaaaccgtacggtacccgttaagggtaaccgggtaaggttacccggaaacgggtaaaccggtacccgggtaccggtttaagttaaacgtttaacggttagtacggggtaccggggtaaaggtacgggtaacggttaccggggattaaaccgggtttacgttaccggttaccgtttaacccgggaccccggttaacgggggaaccccgtacggggttaaccccgttaccgggg

SEQ ID NO: 16623 - DNA, 717 bp, Homo sapiens
  misc_feature: GYAE6OF02GO0F8.22.65.F10.1.454.CMB.1.raw
tcagacatacgcgtcacgaccggtgctcgatttagctacgctctaaggggaggctctgggagaagagccccagccccagaattcccaggagtttccattcggtgatcgacgcactgaacacagaggactcaccatggagtttgggctgagctgggttttccttgttgctattataaaggtgtccagtgtcaggtgcagctggtggcgtcgtgggggagcgttggtcaagccgtggacggtccctgagctctcctgtgcgagtcctcgtaggtacttccccttagacgtcgtacttctacagtagtaagttggactcccggaccgacggccttaccgaggggaacggggtctgggtaggttgggtttacacgttacgtagttagtacggtaggttaggtttaagttttaagtacgtacgtagtacgtcgtggtacggtaacgggtccgtaagtttccgaaccgtacttaccgtaccgtaagggaaccctaaccggaccctaaagaacctcgtaacgtcgttagtccgtagacttaaagtcgaacgacgtaccgtaggagtaacggtcgaacgggtacgtaccgggttaccgttaagttacgtttacggtggtccgggtaacgggaggtacgggtacgttaccgggaggtaacggtttagtcccggtacgtttacccggacccgggttgggaccccggtacggggtacccttacccggg

SEQ ID NO: 16624 - DNA, 749 bp, Homo sapiens
  misc_feature: GYAE6OF02HKQQF.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttggtcaagcctgggacggtccctgacgactctcctgtgcagcctcgtggactttcccccttcagttgaccttctacagtgaattggactcccggcctaggcctccgaggggaaggggcgtggaggtggtttcatacgtattaggtggttagtggttaatttttaaagacgtctaggacttcgtaggtacgaaggggtccctaagttccaacctagtccgtacccgtagggacctaaacggaccctaaaggaaccgtacctaacgtcgttactccgtacgactaaaacgttcgaaaccgtcgtacctacggaagtacggtaccgggaacgggaaccgtacggggtacccgttaaggttaacgtttacgttagggttacgggtaccgggggtaaaggtacggggtaacggtaccgggggtaacgttaacggggtttaacgttccgggttacccgtttttaccccggggacccccgggtttacccgggggggtaacccccggttaaccgggggtaacccccggtttacccggggg

SEQ ID NO: 16625 - DNA, 725 bp, Homo sapiens
  misc_feature: GYAE6OF02I0OJ2.22.65.F10.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
tcagacatacgcgtcacgaccggtgctcgatttagctacgctctaaggggagctctgggagaagagccccagccccagaattcccaggagtttccattcggtgatcagcactgaacacagagactcaccatggagtttggctgagcttgggttttccttgttgtctattataaaggtgtccngtgtcaggtncagctggtggcgtcgtgggggagtcgttggtcaacggccgtgggacgggtcccctaggacgacttccgttccgtgtcgcgacgtcctcgttggtacctttcccccttagtacgttcgtaccttcgtaccagttgaagtttcggacgttccccggacgacggtaccttaccggaagggggaacgggtcgtaggggtagggtttcgggttactaagttacgtacgttaaggtggttaagttaggtttaaatttttaaggccgttagacgttaactcgttaagtacggtaaacgggtccgtacttaccgaaccgtctccgttaacggaacggaccctaacgacctaaacggtaactcccgtaatccggtacttacgaagtacaaagtacaacgtacgaccgtagacggtaacgcgtaaacggccgtaaccggtcgtttaagtattagtacggtcgggtcggtaaagtgggacgttcggacgttaagtcgttcgttaccggtcccgaacggtcgggaacccttacgggacccttcgg

SEQ ID NO: 16626 - DNA, 708 bp, Homo sapiens
  misc_feature: GYAE6OF02F3PUW.22.65.F10.1.454.CMB.1.raw
  modified_base (369)..(369): a, c, t, g, unknown or other
  misc_feature (369)..(369): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtcagtgtcaggtgcagctggtgcgtcgtgggggagcttggtcaagcctggacgggtccctgagactctcctgtgcagcctgtggattccccttcagtgacttctacatgaattggatccgcaggctccgagggaaggggcgtgggagttggttacatactagttaggtggtagttaggttatttttaaanacgactagacttcgtgtaggaagggccgtattccaaccgtatccgtaccgagggtaaccaaccgaccaaagtaactcgtaacgtgtaacttcttacgaactaaagtacgaaacgtacgtaccgttaggaaggtacggtaccgggaaacgggaacccgacggggttaccggttaagttaacggtttaagtttcggggtacggggtacggggaaagggtaacgggtgggtaaccggggtacttaagggttttaacggtcggtttcccgtttttaaccccgggaacccccgggtttacggggggtaaccccggtaaccgggggtaaccccgtttacccgggg

SEQ ID NO: 16627 - DNA, 782 bp, Homo sapiens
  misc_feature: GYAE6OF02I6YOU.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctggttttcctgttgctattataaaaggtgtccagtgtcaggtgcagcgtggtggcgtcgtgggggagcgttggtcaagcctgggacggttccctgacgactcctccttgtcgccagtcctcgtcggtacttcccccgttcacgtgtacttctacactgtaattggactccgcgacggctccggaaggggacgggcgtaggtcggttcgggtttacagtaacgtattacggttagggtagtttggttaaatttttaaaagcgtacgtaacgttacttcggtagttacgggaacgggtaccgttaactttccaaccgtaacctttcccgaccggtaaccgggaaaccgaaccggaacccggtaaaagtaccgttaacaaccggtttacgtaacttccgtacgtaaaccttaaaggacccggtaaacgacccgtccgtaacggtaacggtacgtaccgggtaaacggaccggtaccggggtccgtttaaaggttagttttaacgttaggggtttggttacgggggtaaggtaacggggaccggttacgggtgttaaacggtttcgttaccggttaccggttttcccggaaccccggggtttccggggtaaccggtaccggggttaccccgtaccggg

SEQ ID NO: 16628 - DNA, 727 bp, Homo sapiens
  misc_feature: GYAE6OF02GV2QZ.22.65.F10.1.454.CMB.1.raw
  modified_base (282)..(282): a, c, t, g, unknown or other
  misc_feature (282)..(282): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggtttcgtgtgctattataaaggtgtcagtgtcaggtgcagctggtggcgtcgtgggggagcgttggtcgaagccgtggacggtccctgacgactcgtcctgtgcgagtcctcgtggtactttcccccgttnagtacgtaccttctactagtagtaattcggactccccggaccaacggtccgacccggaagggggaacggggtccgttaggggtaaggttcggggttttaccaagttacgtaagtttagggtggttaacggttagggtttaaatttttaaagtaccggacgtaacgtactttgtaggtacgggtaacggtccgtaactttccgaactactccgtaccggaacgggtaaccaaccgacccgtaaaacgaccttacgaacgttacgttaacttcgtaacgaactaaacgtacgaaacgtaccgtacgtaggacggtacgttacggaacgaacgtaccgggtacgtaggttacgttaagtggtaggacgggtaagacgggtagtccgggtaataggttacgtgtcccggttaccgacccgggttcgggaccgtaccgggtaccgtacgg

SEQ ID NO: 16629 - DNA, 593 bp, Homo sapiens
  misc_feature: GYAE6OF02GLLDU.22.65.F10.1.454.CMB.1.raw
  modified_base (281)..(281): a, c, t, g, unknown or other
  misc_feature (281)..(281): n is a, c, g, or t
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggcgtcgtggggggagcttggtcaagcctgggacgggtccctggagactctcctgtgcagccctctggacttccccttnagttgacttcacatgaattggatccgcaggctcgagggagggctggagttggttacatacagttagtggtagttggttaattttaaancgacagtactcgtagtggaacgggcctatttccaacctntctaccgagggaacaacgaccaaagaactacactagtactctgactaaatacgaacacgctagaagagtcggaagaccgacggccgtagtactttaagtgtaggacgggaaggtacggaggtacgggctaaggttacgtggtccgtttccggaccccgttggggacccgacgggtacccctcggg

SEQ ID NO: 16630 - DNA, 785 bp, Homo sapiens
  misc_feature: GYAE6OF02HZRCU.22.65.F10.1.454.CMB.1.raw
  modified_base (302)..(302): a, c, t, g, unknown or other
  misc_feature (302)..(302): n is a, c, g, or t
tcagacatacgcgtcacgaccggtgctcgatttagctacgctctaagggggagctctgggagaagagccccagccccagaattcccaggacgtttccattcggtgatcagcactgaacacagaggactcacatggagtttgggctgagcttgggtttccttgttgctattataaaggtgtcagtgtcaggtgcagctgggtggcgtcgtgggggaggtcttgggtcaaggccgtgggacgggtccctggacgactctccgtgtgcagcctcgtggacttcccctgacgtcgtacttctactntagtaattggactccgccgaggcctccggaaggggacggggcctgggtacggttcgggtttacagttactagtttaggtcggttaggttgggttaaatttttaaacgacggtacgtaagtaaccgttcgttacggtagggaaaccggggtcccggtaattcccgaacccgtaacgttacccgtacccggtaaaggggtaaacccgaaaccggtaacccgtaaagtaaacccgttaccaacgttacggttacttacgtacgaaaccgtaaagttaacgtaaaccagtacccgttaggaaccggtaacgtacgggaaacggtaccggtaaccgggtccgtttaagttaacggtttaagttgggtacggggacgggtaaacggacgggtacggtaccggggtacgttaaggtttacggtaccggttcctttacccgggtaccccggttaccgggggacccggttaaccgggtaccccggttccggg

SEQ ID NO: 16631 - DNA, 771 bp, Homo sapiens
  misc_feature: GYAE6OF02JQAZS.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaggtgtccagtgtcgaggtgcagcgtggtggcgtcggtgggggagtcgttggtacgaacgtccgtgggacgggtcccgtggacgtactcctccgtggtgcgacgtcccttgtcggtaccttcccccttcgtaacgtcgtacctttctactataggtaagttcggactcccggaccgacggtaccgtaccgggaagggggtaacggggtcgtaggggtacggttcggggtttacaaggttaacgtaaggtttagggttagggttaaggtttagggttttaaatttttaaacgtacggtacgtaacggttacttacggttagggtaggtaacgggtccgtaagttacccaaccgtactacccgtaccggaacgggaaaccgtaaccggaacctaaacggaaccttacgtaaccgtagttactacgtacgaactaaagtaccgaacgtacgtaccggtagaccggtagtaccggaagaccggtacggtaccgttagttaacgttaagttggacggtagggtaagacgggtggtacggtgtaacggttgtacggtccgttaccggacccggtcgggacccggtacgggtacccgttaccgg

SEQ ID NO: 16632 - DNA, 868 bp, Homo sapiens
  misc_feature: GYAE6OF02FMD08.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccagtggagtttgggctgagcttgggttttcctgttgctattataaaaggtgtcagtgtcaggtgcagctggtggcgtcgtgggggaggcttgggtaccaaggccctgggacgggttcccctggacgaccttctcccgtggtcgcacgccttcgtggtacctttccccctgaacggttcgtaacctttcctaactagttaggtaacgttgggaaccgttccccggccgtaacgggtcccgttaccggaaggggggtaaacgggggtcttacgggggtagggtttgggttttaccgaacgttaacgtaggtttaacggttaggggtttaagtttagggttttaaaagtttttaaaacgtacggtaccgtaacgtactttccgtggggtttaaggggaaccgggtccgttaaacgttccctaacgtacgttccgtaaccggaacggggtaaaccgaaaccgtaaccccgaaaacggttaaaccctaccgtaccgttacggttaacttaccggttaacggaaacttaaacggtaaacctaacgtacgtaccgtaagggaacgtaccggtacggaacggtacggtaaccgggttaccggttagtttaacggtttaagttcgggtaagggcgggaaacgggaggtaaccggtcgggtaacggttaacggttacgttaccggttaccggttacccgggttacccgggttacggggaccccggtacccggggtaaccgttacccggg

SEQ ID NO: 16633 - DNA, 743 bp, Homo sapiens
  misc_feature: GYAE6OF02F9L29.22.65.F10.1.454.CMB.1.raw
  modified_base (278)..(278): a, c, t, g, unknown or other
  misc_feature (278)..(278): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagccgtggagggtccctgagactctcctgtgcagcctctggtacttcccccttnagtgactttctacatagaattggactccgccaggtctccgaggggacgggcgtgggtaggttgggtttcagttacgagttaggtggttaagttggtttaatttttaaaactacgtctaacggtacttcgttaggtaggtaacggggccgtaactttccgaacctacttccgtacccgaacgggaaccaaaccggtacccaaaacgtaacctaccgaacgttacgttaacttccgttacgactaaagttacgaaacctaggtacccgtagaacggtacggtaccgggaacggtaccgaaccggggtcccgttaggtttaaacgtttcgttagggttacgggtaccggggaaagggtacggggtaaggttaccgggggtacgtacggttttaacgtacgttacccggtttacccgggtaccccccggttgggggaaccccgtaccgggggtaacccccttaccgggg

SEQ ID NO: 16634 - DNA, 775 bp, Homo sapiens
  misc_feature: GYAE6OF02I0QXI.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagctggtggcgtcgtgggggaggcgttggtcaagcctgggacgggtccctggacgactctcctgtgcagcctctggtacttccccgttcagtgacttctactactgaattcggactccgcaggctccgagggaacggggtctgggaggttgggtttacacgtacgtattaggtgggttaagttggtttaagtttttaaaacgtacgtactaagtaccttacgttggtagggaacgggtcccgtaacgtttaccgaaccgtacgttacccgttaccggaacggggaaacctaaacccggaccgtaaaacggaaacctccgtaactttacggttacgttaccgtggtaacctaaaagttacgaaaaccgtcggtaccgttaggaacgtacggttacggaaccgggaacgtaaccgggtacccgtttaagtttaacgtttacggttaggtacgggtacggggtaaaggtcgggtaaacgggtttaccggggaacgttaaggtttacgttacggtttacccggttttacccgggaccccgggttacgggggaccccggttaaccggggtaccccgttaaccggg

SEQ ID NO: 16635 - DNA, 743 bp, Homo sapiens
  misc_feature: GYAE6OF02GMR1O.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttggtcaagcctgggagggtccctggagtaccttctcctgtgcacgcctcgtggtacttccccttacgagttgtactttcctacagtgtaaattggactcccgccaggtcctaccggaggggaacggggcttaggggaggtttgggtttacaacgtacgtaagtttaggtaggttaggttaggttttaatttttaaaagtaccggactaaggtacttcgtcggttagggaacgggtcccgtattccgaacctcgttaccgttaccgaggggaacccaaccggacccaaacggtaacctacgaaccgttagttacgtacgttacgactaaagtacgaacgacgtaccgttagaacggtaggtacggaacgggaacccgtaccggggtcgttaaggttactttaagttacgggttggacgggggtaagacgggtacggtacccggggtattaacggtttaacgtcggttaccgtttacccgggacccccggttggggggaaccccgtaccggggttaacccggttcggg

SEQ ID NO: 16636 - DNA, 754 bp, Homo sapiens
  misc_feature: GYAE6OF02H3NYD.22.65.F10.1.454.CMB.1.raw
  modified_base (709)..(709): a, c, t, g, unknown or other
  misc_feature (709)..(709): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccaatggtagttgggctgagctgggttttccttgttgctattaataaaaggtgtcctagtgtcgaggtgcagctggtggcgtgtgggggagtctggtcaagccgtggtacggtcctgacgtactctccgtagtcgcgtacgtcctcgtacggtaccttccccttcgagttcgactttactactagtagtaacgttaggtacctccgaccgacggtacctacccggaaggggaacggggtcgtacgggtaaggtttacgggttacgtaaccgttaagtaggttaaggttcggttaagttgggttttaaatttttaaacgaaccgtacgtaacgtacgttacgttggtaacgtaacgggtcctaacgttacgacccgttaagtcgtaacccggaggtaaaccgtaaccgaaccgttaaacgtaaccgtacctaacggttacgtaaactccgttagtaaacccgttaagtaaaccgtaaaccgacggtacctaaggaacgtacggtacgacggtaaccgtaaccggtcgttactaggttacgttggacggaacgggtaggaggtaacggtcgtaggtaggttancgttaccgtaccgtaccgggtacgggtacggaccggtaccggtcg

SEQ ID NO: 16637 - DNA, 769 bp, Homo sapiens
  misc_feature: GYAE6OF02I4CBV.22.65.F10.1.454.CMB.1.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
tcagacatacgcgtcacgaccggtgctcgatttagctacgctctaaggggagctctggagaagagccccagccccagaattcccaggagtttcccaattcggtgactcagcactgaacacagaggactccaccatggagtttgggctagagcttggttttccttgttgctattattaaaaggtgtccagtgtcgagttcgnagctggtggcgtcgtgggggagtcgttggtcaaggcctcggaggtcccgtagacgtacttcctcgtgtcgcncgtcctcgtcggtacctttcccccttgtagtgtacctttaccctatacgttactaaagttcggtaccgttaccggtacccgtacggtacctccgggtaaggggaacggggtcgaccgggtagggtttcggttacgtactaactaggttacgtagggttaagtttacggtttaagtttttaaaacgaacttcgtaacgtcttacgtacgttcggaaacggtaccgtactttaccgaaccgtactaccgttacccgaaggtaaccaaccggttaacgaaagtaaccctcgtagttacgtattacctgaacttaatacgaaactacgaccgttagaaacggtacgtacggaaacggaccggtaacccggtgttttacggtaaccgttttaatgggtaacccaggggtaacgtaccggtagacgggttacgttaacgtgttaaccggttcccgtacggtaccccggtagggaccccggttaaccggtaccgttacccggg

SEQ ID NO: 16638 - DNA, 758 bp, Homo sapiens
  misc_feature: GYAE6OF02GU1I5.22.65.F10.1.454.CMB.1.raw
tcagacatacgcgtcacgaccggtgctcgatttagctacgctctaagggaggtcggtctgggagaagagccccagccccagaagttcccaggagtttccattcggtgagtcagcactgaacacagaggactcaccatggagtttgggctgagcgtgggttttccttgttgtcctattataaaaggtgtccagtgtcaggtgcagctggtggcgtcgtgggggacgcttggtcaagccgtgggagggtccctaggagacctcgtccgtgttgccgacgtcccttcgtacgggtacttttcccccgttcacggttcggtaacctttaccgtaaccgacgttacgaaagtttaccgggaatttccccggacctagggtaccttcccggaagggggtaacggggccttagggacggttcggggtttaccagtaaccgtagtttagtggttacgtaggtttaattttaaatacggactaagacttcgtgtaggaacgggtcctatccgactactctaccgacgggtaccgaaccgtcccaaacgtaactactagtagtactcgtacggtaactaaacgttcgaaacgcgtacctggaacgtacgtacggacgaaccgtaccggggttccttaaggttactttagtcgggtacggacggggtaaggacccgggtaaggtaccgggactaaggtttaaccgcggtttaccgtttaccccgggtaacccggtcggggtaacccggacggggtaaccccgttccggg

SEQ ID NO: 16639 - DNA, 635 bp, Homo sapiens
  misc_feature: GYAE6OF02IMGRX.22.65.F10.1.454.CMB.1.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (487)..(487): a, c, t, g, unknown or other
  misc_feature (487)..(487): n is a, c, g, or t
  modified_base (502)..(502): a, c, t, g, unknown or other
  misc_feature (502)..(502): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttgggtacaagccgtgggacgggttccctaggacgacctcctccgtgtgcagcctntggtacttccccgttnagtcgtacttctacatgtaagttggactccgaccgtaggtcctaccgtaaggggacgggcgtgggtaggttgggtttacaataacgtagttaggtgggtaggttaggttaatttttaaactacgtactagtactcgtgtacggaagggccgtattccactatactccgaggaccaacgaccaagaactacacgtntactacgtgactaanacgaacacgcgtagagacgtacgacgacgacggtaccgttggtaattgttagacggacgggaagtcgggtaggtaccggactaggttatcgttcgttaccggcccgtacgggaccgtaccggaccccgtacgg

SEQ ID NO: 16640 - DNA, 653 bp, Homo sapiens
  misc_feature: GYAE6OF02FIGNV.22.65.F10.1.454.CMB.1.raw
  modified_base (278)..(278): a, c, t, g, unknown or other
  misc_feature (278)..(278): n is a, c, g, or t
tcagacatacgcgtcacgaccggtgctcgatttagctacgctctaagggagctctgggagaagagccccagccccagaattcccaggagtttccattcggtgatcagcactgaacacagaggactcaccatggagtttgggctgagctgggtttcctgttgctattataaaaggtgtccagtgtcaggtgcagctggtggcgtctgggggagcttggtcaagcctgggagggtccctgagtactctcctggtgccagccctcgtggacttcccctttnacgttgtacttcgtacatgattggatccgcaggcctcagggaaggggctgggagttgggtttcagtactagttacgtggtaggttcggttaatttttaaagacggtctaacggtacttcgtacgtggtaaacggggtcccgatttaccacctagtacctaccgagggtaaccaaccgaccgaaacgaacttcgaacttagtacttctacggaccaaagttcgaaacctaggcccttagacgtacggtcgaaggtaccgacggtccgtagtacgtttagtcggtacgaccgggtaaggacggtacggtcgggacttacggttactcggtcgtttaccggaccccggttcgggacccgtacgggtacccttaccggg

SEQ ID NO: 16641 - DNA, 957 bp, Homo sapiens
  misc_feature: GYAE6OF02GTI8P.22.65.F10.1.454.CMB.1.raw
tcagacatacgcgtcacgaccggtgctcgatttagctacgctctaagggagctctggagaagagccccagccccagaattcccaggagtttccattcggtgatcagcactgaacacagtaggactcaccatggagtttggctgagctgggtttcctgtgctattataaaggtgtccagtgtcaggtgcagcgtggtggcgtctgggggagcttggtacgaagcccgtagggtacggttccctaggacggtaccttcgtacccgtggtacggccgtaacggtccctacgttacgggtacctttacccccgttacgtaacgttacggtaacctttacccgtaacgtacggttaccgtaaaagttttccggggaacctttacccccgggtaccgtaccggggttaccttacccccgggtaaaggggggttaaaccgggggtccggtttacgggtaaacggggtttcgggttttaacccgacggttaaccgaagttttaaccggggtggttaacggtttacggtttaaccgttttttaaaacggccggttacgttaaacggtaccgtttacgttaacggtacgggtaaaccggggtccgttaacgtcccgtaaaccgtccttacggtaacccgtagggtaacccgaacccgtacccgtaaagacccgtttacgaaccggtttcgtaaggtttacctacggtaaccgtaaaggtaccggtaaactaccgtaacccggtttagggaacggtacgtttaacccgggaacgggttaaccccgggtaccgggttaaccggtttacggtttaaacctttaaggggttccgtttaacggggaccggggttaacgtacggggttaaccggtaacgggttaccggtaaaggttttaacctcgggtttacgtttacccgggtaaccccggttacggggtaacccgggttaccgggttaacccgtcccgggg

SEQ ID NO: 16642 - DNA, 878 bp, Homo sapiens
  misc_feature: GYAE6OF02GP1I8.22.65.F10.1.454.CMB.1.raw
  modified_base (283)..(283): a, c, t, g, unknown or other
  misc_feature (283)..(283): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctggttttccttgttgctattataaaaggtgtccagtgtcaggtgcagcgtggtggcgtcgtgggggagtcgttggtcaagccgtgggacgggtccctgagactcctcctgtgcagcctcgtggactttccccttnagtcgtactttctacattgtaattggaacgtcccggccgacggcctaccggagggggaacggggtccgtaggggtaggttggggttttccaagttaaccgtaagtttaagggttacggggttaaggtttacgggttttaagttttttaaaacgtaccggtacgtaacggtaccgtttacgttaggggttaggaaaccgggggtcccggttaacttacccgtaaaccccgtacgttttaccccgttacccggaaccggggtaaaaccctaaacccgggaccccgtaaaaacggtaaacctaacccgtaaccgtttacgttaaccttacgttaccggaacgttaaaaccgttacgaaaacccgtacggtacccgttacgggtaaccggtaaggttacccggaaacgggacccggtaccggggttaccggttaagtttaacggttttaaggtttaccgggttaggggacggggtaacgggaacgggtaacggttaccggggtaacgttaagggtttacggttaccggttacccggttttccccggaaccccggggttaccggggtaccccgggttaccgggggtaacccgttccgggg

SEQ ID NO: 16643 - DNA, 884 bp, Homo sapiens
  misc_feature: GYAE6OF02I4JJ4.22.65.F10.1.454.CMB.1.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgtgctattataaaggtgtccagtgtcaggtgcagctggtggcgtcgtgggggagctttggcaaggcctgggagggtccctggacgtctcctccttggcgacngccttcgtagtacttcccccttnacgtgtacctttcactatagtaattgggaacttcccggacacgggtcctacccggagggggtacggggtcctaggggtaaggttcggggttaccagttaccgtaaggttaggttaggggtagtttaggttttaaaacgtttttaacgtaaacggttcgtaaacggttaaccttttccggttaagggtaacccggggtaaacggggtacccggtttaactttaacccggaccccttaagttcccgttaaacccggaaggggtaaaccaaccccggacccgtaaaacggttaacccgtacgttaaccgtaccggttaaccgttaccttacggtaaccctaaaaggttaccgaacgttaaccgggtaccctaaggttaacgggaacggttacccgggaaacggttacccgggaaccggttaccggtttaaggttaacgttttccgggtaacggtttacgggggaacccggggttaggtaaacgggggttttcggaaccgggggtcttttaaacggggttcttaccgggtttcccgtttaccggggtaaccccccgggttgggggggtaaccctaacccggggggtaccccgtttacccgggg

SEQ ID NO: 16644 - DNA, 900 bp, Homo sapiens
  misc_feature: GYAE6OF02I82BQ.22.65.F10.1.454.CMB.1.raw
  modified_base (149)..(149): a, c, t, g, unknown or other
  misc_feature (149)..(149): n is a, c, g, or t
  modified_base (716)..(716): a, c, t, g, unknown or other
  misc_feature (716)..(716): n is a, c, g, or t
tcagacatacgcgtcacgaccggtgctcgatttagctacgctctaaggggagctctgggagaagagccccagccccagaattcccaggagtttcccattcggtgatcagcactgaacacagaggactcaccatggagtttgggctgagnttgggttttccttgttgctattataaaaggtgtccagtgtcaggtgcagcgtgggtggcgtcgtggggggagtcgttggtcaagccgtgggtacgggtccccgtgacgtaccttcctcccgtggtgccgacgtccctcgttagggtacctttcccccccgtttctaacggttacggtaccttttcctaaacctagttaggaaacgttttggaaccgttccccggaccgtacggggccccttacccggggaagggggaaacggggggttccgttaagggggtagggttttacgggggtttttccaaacggtttaacccgtaagttttaacggttaggggtttaacggtttaggggttttaaactttttttaaaacggtaccgtacgtaaggtacctttacgttaggtaacgggtaacggggtcccgtaagttttaccccgaaccttactccctacccgggtaagggaaacccgaaacccggtacccgaaaacgtaacccttaccgtaaccgttacggttaacttaccggttagtaacctaaaagtacgaaaccacggtaccgtaaggnggtaacggtaccggaacggaaccgtaccgggtaccgttaagtttaacgtttacgttggttaggggtaccgggaaggtacgggtacgggttaccgggacgttaaggtttaccgtacggtttcccggtttacccgtaccccccggggttagggaccccccggttaacggggaccccgttacccggg

SEQ ID NO: 16645 - DNA, 920 bp, Homo sapiens
  misc_feature: GYAE6OF02HP5JZ.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgttgctattataaaggtgtccagtgtcaggtgcagctggtggcgtcgtgggggaggcgttggtcaagtccgtgggacggtccctaggacgactctccgtgtgcgacgtcctctcggtacctttcccccgttcgtacgttcgtacctttcgtaactagttagtaaacgttggtaccgtcccgaccgacgggtaccgtccggaaggggaacggggtcgtagggtagggtttaggggtttactaagtaacgttagttaaggttagggttaacggttagggttttaaagttttttaaaacgtaccggtacgtaacggtaccttacggttaggtaagggtaaccgggtacccgttactttaccgaacccgttaacgttacccgttacccggtaaaccgggaaccgtaaacccggtaacccgaaaacgtaaaccgttacccgtaaacgtttacggtttaacgttaccgttaacgtaaaccgttaaacgtaaccgtaaacgtacggtacccggttagggtaaaccgggtacggttaaccgggaacgggtaacccggtaaccggggttacccgtttaaggttaaacgtttaacggtttcggggttacggggtaacgggggtaacggtaacggggtaaccgggtttaccgggggtaacggttaacggtttacggtttacccgggtttacccggttttacccccgggtaacccccggggttacccgggggtaaccccggttaaccccgggggttaacccggttacccgggg

SEQ ID NO: 16646 - DNA, 840 bp, Homo sapiens
  misc_feature: GYAE6OF02HXHCF.22.65.F10.1.454.CMB.1.raw
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (616)..(616): a, c, t, g, unknown or other
  misc_feature (616)..(616): n is a, c, g, or t
tcagacatacgcgtcacgaccggtgctcgatttagctacgctctaaggggagctctgggagaagacgccccagccccagaattcccaggagtttccattcggtgatcagcactgaacacagaggactcaccatggagtttgggctgagtctgggttttccttgttgctattaataaaggtgtccaggtntcgaggtgcagcgtggnggcgtcggtagggggcgngttggtcaacgtccgtggacgggtccctgaacgccttctccgtgtcgcgagccttcgtcggtacctttcccctacgtacggttcgtacctttactactacgtacgttaacgttacggtacgtaccccgtacccggacggtccttaccggggaagggggacggggtcggtagggttacggttcggggtttacgtacgttaactaaggtttaggtacgggtttaaggtttagggtttttaaacgttttttaaaacgtaccggtcgtaacgtaccttaggttacgggttacgggtaacgggtaccgtacgtttacccaccttacgttccccggtaaccggaacgggtaaccctaaacggaacccttaaacgaacgttaccctattacggttaacncgttaacacgaaacgttacgaaacgtccgtacgggtacgtaacggtacggaaccggaacggtaaacccgcggttaccgggttactttaagtaggttttaacgggcggggttagggaacgggtaaggtcgggtaccgggtagttaacggttacgtaccggttttccccggttacccggggtaacccggtccggggtaacccggaccgggtacccgttaccccggg

SEQ ID NO: 16647 - DNA, 777 bp, Homo sapiens
  misc_feature: GYAE6OF02HSVHF.22.65.F10.1.454.CMB.1.raw
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccagtggagtttgggctgagcgttgggttttccttgttgcttattaataaaaggtgtccagtgtcaggtgcagctgggtggcggtcggtgggggaggtcgttggtacgagccgtgggacgggtccctggacgctctcctgtcgcncgcctcgtggtaccttccccttanagttcgtaccttctaacgattcgtaagtttggaccttcccggccgtacgggcctaccgggaggggaacgggtcgtaggggtacggttcggggtttacacgttacgtaaggtttagggttacggttagtttaggttttaaatttttaaacgacggtacgtaggtaccttcggttagggtaacgggtaacggggttccgtaaccttaccgaacctacgttaccgtaccggtaacgggaccctaaaccggaccgtaaacggtaacctactacgttacgtactcgtacgtaataaagtaccggaactcgtacgtaggtaacgacggttaccggaacggacgtacccgggtacgttagttaacgttgtttacgggacggttacgggaaggtacgggacggtccgggtaattcggttaccggttcgttacccgtttcccgggaccccggttcgggggtacccgtaccccgggttaccgttaccggg

SEQ ID NO: 16648 - DNA, 706 bp, Homo sapiens
  misc_feature: GYAE6OF02HKCUY.22.65.F10.1.454.CMB.1.raw
  modified_base (545)..(545): a, c, t, g, unknown or other
  misc_feature (545)..(545): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagcgtggtggcggtcgtgggggagcgttggtcaaggccgtgggacgggttccctggacgactcctccgtgtcgcacggcctccggactttcccccttcagttcgaccttctacatagtaagttggactccgccgaggccgtaccggaggggaacgggcgtgggaggtttgggtttacagttactaagttaggtaggttagttaggtttaatttttaaaagcgtacgtacgtaactcgttaggtacggaacgggtccgtaagttcccaacgtactccgtaccgaacggggaaccaaccgaccaaagaacctcgacttagtatctagactaaagtacgaacgagtccgtagnggtaacgtaggaacggacgaccggtcgttagttaacgttagttcggcggtaagggagtaacgggacggtacgggaccgttaagttacgttacggttacccgtttacccggaccccgggtacggggtaccccggtaaccggggtaccgtccggtaaccccgg

SEQ ID NO: 16649 - DNA, 678 bp, Homo sapiens
  misc_feature: GYAE6OF02GR628.22.65.F10.1.454.CMB.1.raw
  modified_base (179)..(179): a, c, t, g, unknown or other
  misc_feature (179)..(179): n is a, c, g, or t
  modified_base (267)..(267): a, c, t, g, unknown or other
  misc_feature (267)..(267): n is a, c, g, or t
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttggttttccttgttgctattaataaaggtntccagttgtcaggtgacagcgtggtggcgtcggtgggggagtcttggacaagccgtgggacggtccctggacgtactccgtctggtcncgacgtcctcgtcgtaccttcccctgacgtcgtaccttgtaactnttagtagttcgaccgttccgacgtcgaccgtacggaggggtaacgggngtggtacggttcggttactagtactagttggttggtatttagttaatttaagtacgtagtactactcgtaggtacgacggtacgtactaccacgtactaccgacgacggaccaacgaccgaaacgactacaacgtctacgtcacgtacaacgttaagaaccgtcgtaacgtggaacgaggtacgaccggccggtaaggtccttagttacgttaagtcgggacggacgggtaacggtaggtaggtaccggacgttaagtacggttccgttaacccggttcggaacccggggtcggtaacggaaccccggtgttaacccg

SEQ ID NO: 16650 - DNA, 870 bp, Homo sapiens
  misc_feature: GYAE6OF02G0YRB.22.65.F10.1.454.CMB.1.raw
tcagacatacgcgtcacgaccggtgctcgatttagctacgctctaaggggagctctgggagaagagccccagccccagaattccccaggagtttccattcggtgatcagcactgaacacagaggactcaccatggagttgggctgagtcgttggtttccttgttgctattaagtaaaggtgtccagtgtcgaggtgcagcgtgggtcggcgtcggtgggggagtcgttggtacgaagtccgtgggacgggtccctgacgtacctcctcctgtcgcgacgtccctcgtcggtacctttccccttcgtacgttcgtaccttctactattagtaagttcggtacgtcccggacgacggtccgtaccgggtaaggggacgggtcgtagggtggttacgggttaccaagttacgtagtttaggttaggttaggttaggttttaaatttttaaacggtaccgtacgtacggtacgtccgttagggtaaggtaccggggtacgttacttacccgtaccgtacgttaccgtacccggtaaacgggaacccaaaccggtaacccaaaacgttacctaccgtacgttacgttaacgttccgtacgaaaccgttaaagaacccggtaaaccgtaaccggtaccggtaagggtaaacggttccggtaacccggggtaaacggggtaacccgtaaacccggggtttaccgttttaaggtttaaccgttttaggggtttaccggaacgggggttacgggtaaagggtacgggtaccgggttaccggtaacggtttaacgttaccgggttaccgtttcccggtttaacccccgggtacccggtcccggggggtaacccggtaaccccgggtacccgtttcccggg

SEQ ID NO: 16651 - DNA, 853 bp, Homo sapiens
  misc_feature: GYAE6OF02HUPI8.22.65.F10.1.454.CMB.1.raw
  modified_base (641)..(641): a, c, t, g, unknown or other
  misc_feature (641)..(641): n is a, c, g, or t
  modified_base (671)..(671): a, c, t, g, unknown or other
  misc_feature (671)..(671): n is a, c, g, or t
tcagacatacgcgtcacgaccggtgctcgatttagctacgctctaaggggagctctgggagaagagcccagccccagaattcccaggagtttccattcggtgatcagcactgaacacagaggactcaccatggagtttgggctgagcgtgggttttccttgttgcgtattataaaggtgtccagtgtcgaggtgcagtctggtggcgtcggtgggggaggcgttggtacgaagtccgtgggacgggttcctaggacggtacctccgtcccgttggtcgacgtacgtcccgttcgtcgggttaccctttcccccgttacgtacggttacgtacccgttttctaaccgtagttaggtaacggtttcgggaaccgtttcccggacccgtaacgggtcccctacccgggtaacgggggtaacggggtcggttacgggggtaacgggttttcggggttttaccgtaaacggttaccgttacggtttaaggggttttaggggtaacgggtttagggttttaaacgttttttaaaacggacgtaacgtaacggttaccgttacgttgggtaacgggtaacgggtcccggttaagttcccaacgttacgttaccgtaccggaacgggtaaccgtaaccgacccggtaanaaccgtacacgttacgtactcgtaacgtanaaacgttacgaacgtacaccgtaggtaaccgacggttaacggaccgaccgggtaccgtacgtacgttagttacgttagggtacgacggggtacgtagggtcggtacgggtactaaggttcgtaggttccgttacccgggacccggttaccggggaaccggtaccggtacccggttacccggg

SEQ ID NO: 16652 - DNA, 872 bp, Homo sapiens
  misc_feature: GYAE6OF02F3QNJ.22.65.F10.1.454.CMB.1.raw
  modified_base (772)..(772): a, c, t, g, unknown or other
  misc_feature (772)..(772): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagttgggctgagctggttttccttgtgctattataaaggtgtccagtgtcaggtgcagtcgtggtgcgtcgtgggggagtcgttggtcaacgccgtgggacgggttccctaggacgaccttccgtccgttggtcgtcgacgtccctacgtcggttacctttccccgttacgtaggttcgtacctttactaacaagttaggtaaacttcgggtaaccttcccggaccgacggtccgtaaccgggaagggggaaacggggtccgtaggggtacggtttcgggtttaacaacgttaacgtagttaagggttacggttaagttacgggttttaaattttaaacgaccgtactaacggtacgtacgtacgggtacgggaaacggtacccgtagttacccaaccgtacgtccgtaaaccgagggtaacccaacggacctaaacggtaaccctagtaaccgtcgtaacttcggaacgtaactaaacggacctaaaccggtaacgttaccgtaaaggaacggtaacggtaaaccgggtaacggtacccgggaaaccgggttaccggtttaaagtttaccgttttacgggtttaggaacccgggggttaaccggggaaagggtacgggttacgggttaaccggggtntttaaacgggttacggtttaccggttaccccggttttaacccggggtaccccgggttaccgggggtaacccggttaacccggggtcccgtttaacccggg

SEQ ID NO: 16653 - DNA, 546 bp, Homo sapiens
  misc_feature: GYAE6OF02HBO3Z.22.65.F10.1.454.CMB.1.raw
  modified_base (192)..(192): a, c, t, g, unknown or other
  misc_feature (192)..(192): n is a, c, g, or t
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttcctgttgctattataaaaggtgtccagtgtcaggtncagctggtggcgtcgtgggggagcgttggtcaagcctggagggtccctggagctctccgtgtgcagcctctggtacttccccttnagtgaccttcactatgtaattggatccgctaggctcgagggagggtcgtggtacgtgggttcagtacagttagtggtagtagttattttaaancgtntacgactctgtagaaggccgattcgactatctcgaggaccaacgaccaagactcacgtgtactgtganaaagtgaacagcctgagagtcgagcgacggctgtatgtgaggcggaagnggacgtcgggatagttacgcgtcgttccgaccggtcggcggtaacggccgtacgg

SEQ ID NO: 16654 - DNA, 703 bp, Homo sapiens
  misc_feature: GYAE6OF02FLB0A.22.65.F10.1.454.CMB.1.raw
  modified_base (327)..(327): a, c, t, g, unknown or other
  misc_feature (327)..(327): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctggagctgggttttccttgttgctattaataaaggtgtccagtgtcaggtgcagctggtgggctcgtggggggagtcttgggtcaaaggcctgggacgggtcccctggagactctcctggtgcagcctctcgggacttcccccgttcagtgacttcgtacatgattggatccgccgacggccncgacgggagggcgtgggaggttgggtttacagttaactagttacgggtggttaaggttgggttaacttttttaaagtacgtacgtaagaccttctggtaggacggggccgtacttacgaccagtccttacccggaagggacctaaaccgacccgtaaacgaacttaccgacctaggtacttacgtcgtacgtaaaacttacggaaaccgtagtcccgtaggtaccgggaagttacggacggtaacgccgggtaccgttagtaccgttagtttcgtagggacgggtaagggagggtacgtcggggacgtacggttagttcggtcgtttacccgggcccccggttacggggcccggttaacccggacccggttacggg

SEQ ID NO: 16655 - DNA, 696 bp, Homo sapiens
  misc_feature: GYAE6OF02F5KOF.22.65.F10.1.454.CMB.1.raw
  modified_base (281)..(281): a, c, t, g, unknown or other
  misc_feature (281)..(281): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttggtcaaggcctgggacgggtccctggagtactctcctgtcgcagcctcgtggacttccccttnagtcgacttctacatgaattggactccgccaggcctccgaggggaacgggctagggaggttgggttcagtactagttacggtggtagtaggttaatttttaaagcgagtacgacttcgtagtagggtaaacggccgtaatttccgaacctacttaccgtacccgaaggggaacccaaaccggccaaaacgtacgtacctacgtagtacgttctaggactaaagtacgaaacgtcgaccgtaggacgtaggtaccggaaggaaccgtccgggtaccgtttagtaacgtttacgttgggtacggacggggaagacgggttacggaccgggtacgttaaggtttacgtgggttacccgttttcccggggaaccccggttacggggggaccccgtaaccggggtaaccccgttccgggg

SEQ ID NO: 16656 - DNA, 740 bp, Homo sapiens
  misc_feature: GYAE6OF02G8WH5.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcccgtgggggaggcttggtcaagcctgggagggtccctgagactctcctgtgcagcctctggacttccccttcagtgacttctacatgtaattggactccgccaggcctccgaggggaggggcgtgggtaggtgggtttcagtactagttaggtaggttaggttaggttaatttttaaatacgtacgtacgtactcgttaggtaggacggggtaccgtacgttccaaccgtacgtacctaccggagggaaccaaaccggacccaaacgaacctctaacgttagtacttacgtagaactaaactcggaaaacctacgtaccgtagaagggtaacggtacggaacggggtaacccgaaccggggttacccggttaaggtttaagtttaacggtttagggtacgggaccgggggtaaaggaacggggttaggtccgggggtaacgttaaggtttacggttacggttacccggtttacccggggaccccgggttaccgggggaaccccggtaaccgggggttaaccccgttaccgggg

SEQ ID NO: 16657 - DNA, 818 bp, Homo sapiens
  misc_feature: GYAE6OF02IFPZP.22.65.F10.1.454.CMB.1.raw
tcagacatacgcgtcacgaccggtgctcgatttagctacgctctaaggggagctctgggagaagagccccagccccagaacttcccaggagtttccattcggtgatcagcactgaacacagaggactcaccatggacgtttgggctgagctgggttttccttgttgctagttaataaaggttctccagtgtcgaggtgacagtcgtaggtcggacgtacggtgggggacgtccgtttggtaccaaggccgttaggggacggttaccccagggtacaccttccgtccgttggcgacgtaccgtccgtccgtagggtacctttacccccgttgaacgtcgtaacctttactaaccttagtagtaacgtttacgggtacccgtccccggtaccgtacggtaccccgtaccgggaaggggggaaaccggggtccggtaaggggtggggtttacgggtttacaaaccgttaagttagtttagggttacggttaaggttacgttttaaagtttttaacgaacggtactacgtacttccggtagtacggacgggtacctattacccgacctacgtccgtaccggaacgggacctaaacgtacccgtagttaaccgtactacgttcgtactcgttaagtaacctaacgtacaacgacgtaccggtagacggtacgtacggacgtaaccggtcggtaaccgttagttaccgttagtagtcgggacggtaacggaggttaacggtaccgggtagttacggttacgttccgttccgttaacccgggtccgggttacccgggtaaccgtacccggggtacgttacccggg

SEQ ID NO: 16658 - DNA, 752 bp, Homo sapiens
  misc_feature: GYAE6OF02IM9XW.22.65.F10.1.454.CMB.1.raw
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaagggtgtccagtgtcaggtgcagctggtggcgtcgtgggggaggcttggtcaagccgtgggacggtccctgacgacctctcctgtgcgacgccttacgtcggtactttcccccgttctagtcgtacttacactagtagtaagttggactcccggaccgacgggtccgtaccgggaaggggtaacggggcgttggggtagggttgggtttacaagtactagtttaggtggtttaaggttaggttaatttttaaacgacggtacctaggttacttcggtaggttacggaacgggtaccgtattaccaccgtattacccgacgtaacgggaacaaccgaccgaaacgtaacctactaccgttagtacttacgtagtaactaaagtaccgaacgtacgtacctaggaacgtacggtacggaaacggaacgtaccgggtcgtttaagtaagtttacggttaggtagggacgggtaaggacgggtaacggtacccgggtagttaacggtttacgtaccggttaccgtttacccgggtacccccgggtacgggaacccgggtacccgggtaaccgttcccgggg

SEQ ID NO: 16659 - DNA, 757 bp, Homo sapiens
  misc_feature: GYAE6OF02H19AL.22.65.F10.1.454.CMB.1.raw
  modified_base (563)..(563): a, c, t, g, unknown or other
  misc_feature (563)..(563): n is a, c, g, or t
  modified_base (668)..(668): a, c, t, g, unknown or other
  misc_feature (668)..(668): n is a, c, g, or t
tcagacatacgcgtcacgaccggtgctcgatttagctacgctctaaggggagctctgggagaagacgccccagccccagaacttcccaggtagtttccattcggtgatcagcactagaacacagaggactcaccagtggtagtttgggctgagtcgttcgggttttccttgttgtacttaattaagttaaaaggtcgtacctagtgtcgtaggtgcagtcgtggtggtcggtcggtgggggagtcgttggtacacggccgtgggacggtccgtaggtacgtacttccgtccgtggtcgcgacgtccgtcgtcgtaccttcccgtgacgtcgtacttctactagtagtaagtcgacgtcgccgtacggtctaccggagggacggtcgtagggtacggttacgggttactaagtacgttaggttacggttaggttaggtttaacggtttaaattttaaacgcggtaacgtacgtaacgtggtacggtaaggaaccggtccgtactacctacctacgtaccgtacgaacggtaaccaaccgaccaaagtactacgtaactgttacncgaacgtaaacaacgtcgtaaaccgaggtaccgtaggaagtaacgcggaaaccggtcgtacggttaccgtagttaattgggtaccggtaggaaccgggtaacggnggtacccggtacggacggttaacgttacgtacggttcccgttaccggggtacccgggaccgggttacggaaccccgggttctacccggg

SEQ ID NO: 16660 - DNA, 792 bp, Homo sapiens
  misc_feature: GYAE6OF02GC6W3.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaggtgtccagtgtcgaggtgcagtctggtggcgtcgtgggggagtcttggtcaagcctgggacggtccctggacgtacttcctcctggtcgcacgccttcgtcggtactttcccccgttcgacgttcgtactttcctaactattagtaagttggtactaccccggccgtacggtccgtaccggagggggaacggggtcgtcgggtaggttcggggtttacacgttaacgtagttaggtgggttacggttaggttttaattttttaaacgacgtacgtagtaccgtagtgtacggaaggggtccgtacttaccgaccttacgtccctaccggaacgggaaacctaaccgaacccgtaaagtaaccctaccgtaaacgttacggttaactaccgttacgtaacctaaacgttacgaaacgtccgtaccgtaggaaccgacgggttaacggaacgggtaccgacccgggttaccgttaacggtttaagtttacgtttagggacgggttaacgggggaacggtaacggggacggtacggggtactaaacgggtttcgtaccggtttccgtaacccgggtccccggttaccggggacccgtaaccgggttacccccggtacgg

SEQ ID NO: 16661 - DNA, 974 bp, Homo sapiens
  misc_feature: GYAE6OF02FO9S6.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttggctgagcttgggttttccttgttgctattataaaggtgtccagtgtcaggtgcagcgtggtgcgtcgtgggggagtccttggtaccaaggcctgggtacggttccctggacgtctccgtcgtagtagcgacggtcctacgtggtactttcccccgttacgaacggttacgtactttaaccgttacccgaattcgggtaaacttaggggttaccttcccggtaccccgtaaggggtccccgtttaccggaacgggggggaaaaccgggggttccgtttacgggggtaacgggtttaggggtttttacccgaacgtttaaaccgttaaggttttaggtttacggggttaaggtttacgggtttttaaaccgtttttttaaaacaccgggtaccgttaaaccggttacgttttaacccgggttagggtaacgggtttaaaaacccggggggttcccgggttaaaccgtttttaacccggaaacccgtttaaaccggttacccccggttttaaacccgggtaaccggggaaaccccgggaaaacccgttaaccccgggtaaaaccggttaaacccgtacgttaacccgtttagtaacgtttaccgtacggtaaacctaaacgttacggtaaaccgtaccgtaccgttaacggtaggacggtttaccgaacgggtaacgtacccgggtacggttaccgttacgtttaagttttacgtacgggtacgggaacggtacgggtaacggttaccgggacgttaacggttaacggtttcgtaacccgtttcccggttacccccggggtagggtaccccgggtaacgggtaaccccgttaccggg

SEQ ID NO: 16662 - DNA, 938 bp, Homo sapiens
  misc_feature: GYAE6OF02FSY7Q.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttggctgagctggttttccttgttgctattataaaaggtgtccagtgtcaggtgcagctggtggcgtcgtgggggaggtcttggtccgaaggtcccgtagggtaacggggttcccctggaacggtaccttcgtaccctggtgaccgacgtccctcgtcggtacctttcccccgttgtaacgttcggtaacctttctaactagtagtaaacgtttcgggaccgtcccggtaccgaacgggtccttacccggaacggggggtaacgggggtaccgttcggggtaagggttttccggggttttacctaaagtttaaccgtaaggttttaagggttaggggtttaaggtttaagggttttaaattttttttaaaaacgaccggttaacgtaacggttaaacgtttccggttacgggttaagggtaaaccggggttaccccggttaaagtttaaccccgtaacccttaccgtttacccgttaacccgggaacggggtaaaccgtaaaaccgacccgttaaaacgaaacccgttactaaaccgttacgttaacttacgttaaccggtaacgttaaactaaccgtaaaccgagtacccgtaaggtaaccggtaccggttacggaaggtaccggtaacccgggtccgtttaacggttaagtttaacgtttcgggttaacggtacggggtaaaggtaaccgggtaggttaacccggggtacttaagggtttacgttacggtttaccgtttaccccggtaaccccgggtttacggggaaccccggtaccggggttaaccccgtacccgggg

SEQ ID NO: 16663 - DNA, 759 bp, Homo sapiens
  misc_feature: GYAE6OF02F5HOG.22.65.F10.1.454.CMB.1.raw
  modified_base (182)..(182): a, c, t, g, unknown or other
  misc_feature (182)..(182): n is a, c, g, or t
  modified_base (624)..(624): a, c, t, g, unknown or other
  misc_feature (624)..(624): n is a, c, g, or t
  modified_base (658)..(658): a, c, t, g, unknown or other
  misc_feature (658)..(658): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttggctgagctgggttttccttgttgctattataaagtgtcagtntcagtgcagctggtgcgtcgtgggggacgtcttggacaagccgtggacgggtcccctgagactctcctgtgcagcctcgtggactttcccccttcacgtgtaaccttctaactatgaagtttggacttacccggccgtaggacctacggaaggggaacggggctcgggaacgttacggggtttctaacgtacgtagttaggtaggttacggttaggttaaattttttaaacgacgacgtaagtactacttaggtacgaaggggtaccgacgttttccgaaccttaagtacccgttaccgaaccgggtaaaccgtaaaccgggaaccccaaagtaaacccgttacgtaaccccgttagtaaacttccgttaggaaccctaaaagttcgaaactacggacccgttagaacggtagtcgaaccggaacgtaccggtaaccggttnttaaccgttagttacggttacggaccgggtaaanacgggtaaggttaccgggacgttaaaccggtttagttaccgttacccgtttaacccggtaccccggttagggaaccccgacgggtaaccccgttacccggg

SEQ ID NO: 16664 - DNA, 728 bp, Homo sapiens
  misc_feature: GYAE6OF02F5CZA.22.65.F10.1.454.CMB.1.raw
  modified_base (274)..(274): a, c, t, g, unknown or other
  misc_feature (274)..(274): n is a, c, g, or t
tcagacatacgcgtcacgaccggtgctcgatttagctacgctctaaggggagctctgggagaagagccccagccccagaaattcccaggagtttccattcggtgatcagcactgaacacagaggactcaccatggagtttgggctgagctgggttttcctgttgctattataaagtgtccagtgtcaggtgcagctggtggcgtctgggggagcttggtcaagcctggacggtccctgagactctcctgtgcagcctcgtggtacttccccttnacggtgaccttcgtacctagtacgtaagtttggaacttcccgaccgtagggccttacccggaagggggaaacggggtcgtagggaggttcgggtttacaagtaccgtaagtttaggtaggttagttaggtttaatttttaaagaccgtacgtagtaacttcgtaggtaggaaacggggtccgtatttccgaacctagtccgtaccgacgggtaaccgaaccgaccgtaaaagtaacctcgtaacgtagtaactacgttacgaaccgtaaaattaccgaaactacgtaccgtagaaggacggttaccgaagggtacccgaacgggtcccgttagttaactttaggttaggtacgggacgggaaagtacgggcggtacgggtagtaaggtttacgtacggttccgtttacccggaaccccgggtcggggtaacccctaacgggttaccccgtacgg

SEQ ID NO: 16665 - DNA, 819 bp, Homo sapiens
  misc_feature: GYAE6OF02HQVG6.22.65.F10.1.454.CMB.1.raw
  modified_base (180)..(180): a, c, t, g, unknown or other
  misc_feature (180)..(180): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccagtggagtttgggctggagctgggttttccttgtgctataagtaaaggtntaccagtgtcaggtgcagcgtggtgtcgtcgtagggggacgtcttggtacaagtcgtagggtacggtcctaggagtacctccgttaccgtgtacggactacgtccctcgtacgtacccttcccctagtaacgttcgtaccttactaacgtagttacggtaagttcgggaacttaccccggaccgtaaagggtcctaaccgggtaagggggacggggtcgttacgggtacgggttcggtttaacaacgttacgtaagtttacgggagggttaagtttaggttttaaaccgtttaaaacgtccggtaactaacggttaaccgttggttaacggtaccgggtaaacgggtaccgttacttaacccgtaaccgtattaccgtaacccgggtaaaacgggtaacccaaaccgggtaaccgaaaacgtaaaccgtaccgtaacgggtacgttaaccttaacggaacgtaacgtaaaaacgttccgaaacgtaccgtaccggtagaacgacggttaacggaacgtacggtacggtacttagtagttacggttggaccggagggtaacgtacggtggaccggtatacggttaacgtaccggttacgttaccggaccggttacgggaaccggtacgtacccggtaccg

SEQ ID NO: 16666 - DNA, 764 bp, Homo sapiens
  misc_feature: GYAE6OF02HH9X5.22.65.F10.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (390)..(390): a, c, t, g, unknown or other
  misc_feature (390)..(390): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgttgggttttccttgttgctattaagtaaaaggtgtccagtgtcaggtgcagcgtggtggcggtcgtgggggagtcgttggtacaaggccgtggacggtccctgacgtactcctcgtgtgacncgcctcgtaggtacctttccccgtnagtcgtaccttctacntagtaattcggactccgcgtaggcctaccgggaaggggtacggcgtggtaggttcgtttacgaatacgtagtttaggngggtttacgttagggtttaaactttttaaacgacggtacgtaaagtccttacgggttagggacgggtaacgggttcccgtaacttcccgactaatcccgtaccggaacgggaaactaaaccgaaccgtaaacgtaacctacgtaacgttacgtacttacgaacggttaccgaaatacgaaacctacggtccgtaaagtacggtacggtaacggacgggaacggtaccggttacgtttacgttactttaggtcgggtacggggaagggtaacggtaacgggtaggttcccgggaagttaacgttaccggttggtttaccccgttcccgggacccggttaccgggggaccgttaccggggtacccccgttaccggg

SEQ ID NO: 16667 - DNA, 997 bp, Homo sapiens
  misc_feature: GYAE6OF02ICH7F.22.65.F10.1.454.CMB.1.raw
tcagacatacgcgtcacgaccggtgctcgatttagctacgctctaaggggagctctgggagaagagccccagccccagaattcccgaggagtttccattcggtgatcagcactgaacacagaggactcaccatggagtttggctgagtctgggttttccttgtgctattataaaggtgtccagtgtcaggtgcagtcgtggtcggcgtgtcgggggagtcgttcggtacaacggtccgtgggtacggtcccgtagaacgtaccttccgtccgtggtcgccgtacgccgttcgtacggtacctttcccccttacgaggttaccgtacctttactaaccgtagttacggtaaatttcggaacctccccgtacccgtacgggtccgtacccggaggggggtaaccgggtcggtacgggtacggttttacgggttactagttaacggtagtttaggtagggttacgttaggtttaacttttaaacgcggactacggtacctacggttaggtaacgggtaacggggtcccttaagttcccgaaccgttacttaccgtacccggtaacgggaaccctaacccggacgtaaaccgtaaccttacgtaaccgttacggttaaccttacgttaaccgtaacgttaaaccgtacggtaacccgtaacggtacccggttaaggtaaacccgggtaacgggttacccgggtaaacggggtaacccggttaacccgggggttccccggtttaaaggggtttaaaccctttttaggggtttaagggggtacccccggggtttaaaggggggaaacccggggttaacggggggtaaacccgggttttaaccccgggggggaagttttaaccgggtttttaacccgggttaccccgggttttaaccccgggtttttaacccccccgggggttacccccggggtttaaccccggggggggtaacccccggtttaaaccccccgggggggtaccccggttttaaaccccgggggg

SEQ ID NO: 16668 - DNA, 870 bp, Homo sapiens
  misc_feature: GYAE6OF02F4R7S.22.65.F10.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagacatacgcgtcacgaccggtgctcgatttagctacgctctaagggaggctctgggagaagagccccagccccagaattcccaggagttccatcggtgatcagcactgaactacagaggactcaccatacggtagtttgggactgagtactgggtttccttgttagcctaagtataaacggtgtcctagtgtccaggtncagctgtggctcgtagggggactgttggcaacgtccgtacgggtagggtccctggaatcctacgtccgttagtcgactacgtcccgtcgtacggtaccttccccttanaggttcctaccgttattaaccacgtagtaaccgtaagggtccctccggtaccctaaagggtcccgtaccggaaagggggtaaccggggtcctacggggtacgggtttacggttaccctagtaaccgtaagtttcgggtagttaggttagggttaacttttaacggccgaagtaacgtccgttagtagggttaacccggtaacgggtccttacgttaacccgcgtaacgtttcccgaacgggtaaccggggtaacctaacccggggtaaaaccaaaccggtttaaccggtacttaccggttaagttaccttaacggtaaattaccccaaggtttaccaacggttaaccgtacccgttaagaacggttaacccggttacggtaaccgtacccggaaccggtcgggtttaacttaaacccggttgttcgggtaaaccgggtcgggtaaaccgtgggttaacgggtaacccgtaggttacccggttaacgttacccgtttacccggggtttaacccggaccccgggttacgggtacccccgtacggggtttaccccctacccgg

SEQ ID NO: 16669 - DNA, 785 bp, Homo sapiens
  misc_feature: GYAE6OF02HO9R9.22.65.F10.1.454.CMB.1.raw
  modified_base (230)..(230): a, c, t, g, unknown or other
  misc_feature (230)..(230): n is a, c, g, or t
  modified_base (514)..(514): a, c, t, g, unknown or other
  misc_feature (514)..(514): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccagtggagtttgggctgagcgttgggttttccttgttgctattaagtaaaggtgtccagtgtctaggtgacgagtcgtgggtcggtcgtcggtaggggggnggtcgttgggtaccaacggtccgtggggtcggttccccgtaggacgtaccgttcttcccgtgttcgtaccgcggtcccttccgttcgggttaacccttttcccccgttatacggttcgtacccttttactaacctagttacgttaaagttacgggtacctcccggtccgaacgggtcctaccggaaggggggacggtcggtagggttgggtcggtttacgtaacttacgttaagttggtaggtaggtttacggtttaattttaaagacggtctaacggtacgtnttaggacggtaggtaccgtagttccactacgtcgtaccggtaacggacaacccgacaacgtaaccgtacgtactagtactcgtagaaccttaagactaacgaacctacgacgtagtaccgtggaccgacgtaccgtacgttacggtattacggttggtacggtacggggtaaggtcgggtaggtaccgggtattacggttaacggtcggtttaacccggttccggttacccgggtaaccggggcccggtaaccggtaccccggttacccgg

SEQ ID NO: 16670 - DNA, 781 bp, Homo sapiens
  misc_feature: GYAE6OF02JL8HI.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctggtttccttgttgctattataaaggtgtccagtgtcaggtgcgagtctggtggcgtcggtgggggagcgttggtcgaagcctggacggtcccgtgacgctctccgtagtcgcgcgcctcgtggtaccttccctcaagtcgtacttctactatacgtattcggacgttcccgccgacggtaccgtccggacggggtaagggtcggtacgggtagggttcgggtttaacgtattaaccgtagtttaggtcggttagttacggtttaaatttttaaacgtacgtacgtagtaccttacgtagggtaggacggggtaccttacgttacctaaccgacgttaccgtaccggtaaccggaactaaccggaaccctaaacgtacctcctaacgttagtaacgtccgtagaaccgtaaagaaccgtaaacgcccgtaggacgtaacggttacgaaccgggtacggtaccgtaacgggttccgtttaggttaaagtttacgttacgggacgttaaccggggagggtaaccgggtcggttaccgggaacggtttaagttcgggtttaccgggttaccccttacccggggttaaccccggttccgggggtaacccggtaaaccggttccccggttaaccgggg

SEQ ID NO: 16671 - DNA, 489 bp, Homo sapiens
  misc_feature: GYAE6OF01CKBCW.9.12.B01.1.454.CMB.1.raw
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
  modified_base (481)..(481): a, c, t, g, unknown or other
  misc_feature (481)..(481): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttatacggctccgacaacaagaactacttagcttggtatcagcagaaaccaggtacagcctcctaaactgctcattaactgggcatctaccggcaatccggggtcctgaccgattcagtggcagcgggtctgggacagatttcactctcaccatcagcagcctgcagctgaanatgtgcagtttatactgtcaactgttttcncgggcttcggcaaggaccaaggtaggaaatcaaacgaactgtggctgcaccatctgtcttcatcttccgcatngagcgtac

SEQ ID NO: 16672 - DNA, 504 bp, Homo sapiens
  misc_feature: GYAE6OF01B3KUO.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggtcgttcggccaaggggaccaagggtggaaatcaaacgaactgtggctgccaccatctgtcttcatcttcccgcatctgagcgtac

SEQ ID NO: 16673 - DNA, 501 bp, Homo sapiens
  misc_feature: GYAE6OF01CHAFN.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagattcccatctcaccatcagcagcctgcaggctggaagatgtggctagtttatactgtcaactagtttctcgggtcgttcggccgaagggaccaaggtaggaatacaaacgactgtgctgcacatctgtcttcatcttcccgccatctgagtcgtac

SEQ ID NO: 16674 - DNA, 543 bp, Homo sapiens
  misc_feature: GYAE6OF01D8EMZ.9.12.B01.1.454.CMB.1.raw
  modified_base (245)..(245): a, c, t, g, unknown or other
  misc_feature (245)..(245): n is a, c, g, or t
  modified_base (532)..(532): a, c, t, g, unknown or other
  misc_feature (532)..(532): n is a, c, g, or t
tcagtgatacgtctcacgaccggtgctcgatttagtagtgtagattccggcgggggagctacaacaggcaggcagggcaagcaagattggtgttgcagacccaggtcttcatttctctgttgctctggatctctggtgcctacggggacagtcgtgatggacccagtctccagtactccctggctggtgtactctgggcgagagggccaccatcaactgccaaggtccagccagacgtgttttanaccggctccgaacaacaagaactacttaggcttggtatcagcagaaaccaggacagcctcctaaactgctcattaactgggcatcgtacccggcaacgtccggggtccctgaccgattcagtgcgagcggtctgggacagatttcactctcaccatcagcagcctgcaggctgaagatgtggctagttttatactgtcaactagttttccgcgggtcgttcggaccgaagggaccaaagggtggaaattacgaaaacgtaactggtcggactggaccaccgatcttntccgttctacg

SEQ ID NO: 16675 - DNA, 514 bp, Homo sapiens
  misc_feature: GYAE6OF01EQ3S1.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcaggcggtctgggacagatttcactctcaccatcagcagcctgcaggctgaagatgtggctagtttatactgtacaactagttttctcgggtcttcggccgaagggacctaagggtggaaagtcgaaaacggaactggtggctgcaccatctgtcttctac

SEQ ID NO: 16676 - DNA, 533 bp, Homo sapiens
  misc_feature: GYAE6OF01D4AN2.9.12.B01.1.454.CMB.1.raw
  modified_base (211)..(211): a, c, t, g, unknown or other
  misc_feature (211)..(211): n is a, c, g, or t
  modified_base (415)..(415): a, c, t, g, unknown or other
  misc_feature (415)..(415): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctacctaaactgctcattaactgggcatctacccggcaactccggggtccctgaccgattcagtggcagcgggtctgggacagattcactctcaccatcagcagcctgcaggctgaagatgtgctagtttatactgtcaactagttttcncgggtcgttcggaccgaagggaaccgaacggtaggtaaatacgaaacgaacgtagtcggctcgacacctactcgtgttccttctacttccttcccgtccacttctagaagtacgtacg

SEQ ID NO: 16677 - DNA, 563 bp, Homo sapiens
  misc_feature: GYAE6OF01B3PIG.9.12.B01.1.454.CMB.1.raw
tcagtgatacgtctcacgaccggtgctcgatttagtagtgtagattccgcgggcagcgaaagatggtcgttgcagacccaggtcttcatttctctgttgcgtcctggatctctggtggcctacggggacatcgtgatgaccccagtctccagactccctggctgtgtctctgggcgagagggccaccactcaactgcaagtccagccagagtgttttatacggctccgacaactaagaactacttagcttggtatcagacagaaacctaggacaggccctaccgtaaaactgctaccagttaaaccgtcgggacactcctacccggcaatccggggtcctgaccattcagtgcagcgggtctgggacagtatttcacgtctcacatcagcagcctgcaggctagaacgagtgtggctaagtttatactgtacaaactgttttcgcgggtcgttcggtcaacgggactaaggtagaaatacgaaacgacttcgacggtctggtaccaaccgtacgtcgttagttccttacacgtttcccgactactctagtaacgacgtctacg

SEQ ID NO: 16678 - DNA, 505 bp, Homo sapiens
  misc_feature: GYAE6OF01CZVTN.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagatttcactctcaccatcagcagcctgcaggctgaagatgtggctagtttatactgtcaactagttttctcgggcgttcggcaaagggaccaaggtaggaaatacgaaacgaactgtaggctgcacatctgtcttcattccttccgccatctgaagcgtac

SEQ ID NO: 16679 - DNA, 582 bp, Homo sapiens
  misc_feature: GYAE6OF01BWX0U.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactactagcttggtatcagcaagaaaccaggacagcctacctaaactgctcattaactgggcatctacccggcaagtccgggtcctgaccgattcagtggcagcggtctgggacagatttcactctcaccatcagcagcctgcaggctagaagatgtggctaagtttattactgtacaacgtagttttaccgcgggtcgttcgtaccgaagggaacccgaagggtaacgggtaaagtaaccgaaacgaacgttacggtcggacgtacgaccgtaaccacgttaccgttagttccgtttacctacgttaccccttccccgtaccctaactacttacggtaaagtacgttaaacg

SEQ ID NO: 16680 - DNA, 503 bp, Homo sapiens
  misc_feature: GYAE6OF01EALLE.9.12.B01.1.454.CMB.1.raw
  modified_base (417)..(417): a, c, t, g, unknown or other
  misc_feature (417)..(417): n is a, c, g, or t
  modified_base (499)..(499): a, c, t, g, unknown or other
  misc_feature (499)..(499): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaaactgctcattaactgggcatctacccggcaatccggggtcctgaccgattcagtggcagcgggtctgggacagatttcactctcaccatcagcagcctgcaggctagaagatgtggctagtttattactgtcaactagttttcncgggtcgttcggcaaagggaccaaggtaggaaatacgaaacgaactgtgctgcacatctgtctcatctcccgcatctcgagngtac

SEQ ID NO: 16681 - DNA, 590 bp, Homo sapiens
  misc_feature: GYAE6OF01BYCDK.9.12.B01.1.454.CMB.1.raw
  modified_base (298)..(298): a, c, t, g, unknown or other
  misc_feature (298)..(298): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttatacggctccgaacaaacaagtaactacttagctttaggtatcagcaagaaaccaggacagcctacctaaactgctacaattaacgngggacactccgtacccggcaacgtcccggggtccctagaccgtattcgagtcggcaggccgggtcgtgggaaccagtactttcactcgtaccaaccatcagccagtccctgcaggctagaacgntggtacgtataagtttatacgtgtactaacgttacgttttaccgcgggtacgttccggacggaacggaacgtaagggtaagaaacgtacgaaacgtaacaggtacgcacggaccacctagtcgtcttacttctactccttacccgactactacgagtacgtacgtacg

SEQ ID NO: 16682 - DNA, 516 bp, Homo sapiens
  misc_feature: GYAE6OF01CZI7U.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctaccggcaatccggggtcctgaccgattcagtggcagcggtctgggacagatttcactctcaccatcagcagcctgcaggctgaagatgtggctaagtttattactgtctaactagttttctcgggctttcggaccgaagggaccaaagggtagggaaatacaaacgaactgtaggctgaccacatctgtcttcattcctacccgcctatctagaagtcgtac

SEQ ID NO: 16683 - DNA, 529 bp, Homo sapiens
  misc_feature: GYAE6OF01CXDK2.9.12.B01.1.454.CMB.1.raw
  modified_base (235)..(235): a, c, t, g, unknown or other
  misc_feature (235)..(235): n is a, c, g, or t
  modified_base (393)..(393): a, c, t, g, unknown or other
  misc_feature (393)..(393): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagatgttttanacggctccgacaacaagaactacttagcttaggtatcagcaagaaaccaggacagcctacctaaactgctcattaactgggacactctacccgcaacgtccgggtccctgaccgattcagtgcaggcggtctgggacagtattcactctcaccatcancagcctgcagcgtagaagatgtggctagtttacttactgtactacgtagtttccgtcgggcgttcgaccgaacggacgaggtagtaagacgaaacgacgtagcggtacgtagacgacctactactctcttctaccg

SEQ ID NO: 16684 - DNA, 507 bp, Homo sapiens
  misc_feature: GYAE6OF01DQDDC.9.12.B01.1.454.CMB.1.raw
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctaccggcaatccgggtccctgaccgattcagtggcagcgggtctgggacagatttcactctcaccatcagcagcctgcaggctgaagatgtgctagtttattactgtcaactagttttactcgggtcgtttcgccgaagggaccgtaaggtaggaaagtacaaacgaactgtaggctgcaccatctgtctcntcttcccncactctnagagtacg

SEQ ID NO: 16685 - DNA, 518 bp, Homo sapiens
  misc_feature: GYAE6OF01DEM6W.9.12.B01.1.454.CMB.1.raw
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcaagaaaccaggacagcctcctaaactgctcattaactgggcatctaccggcaacgtccggggtcctgaccgattcagtggcagcgggtctgggacagatttcactctcaccatcagcagcctgcaggctagaagatgtgctagtttattactgtacaactgttttctcgggcgttcgcgaaagggaccaaggtaggaaatacgaaacgtaactggngctgccacatcgtntcttcacttccttcccggacactctacgaagtcgtaacg

SEQ ID NO: 16686 - DNA, 508 bp, Homo sapiens
  misc_feature: GYAE6OF01CQS09.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaaacaagaactacttagcttggtatcagcagaaaccaggacagcctcctaaactgctcattaactgggcatctacccggcaatccggggtcctgaccgattcagtggcagcggtctgggacagatttcactctcaccatcagcagcctgcaggctgaagatgtggctagtttatactgtcaactagttttctcgggtcgttcggccgaagggaccgtaaggtaggtaaatacaaacgaactgtgctgctacatctgtcttcactcttcccgccatctgaagtgtac

SEQ ID NO: 16687 - DNA, 535 bp, Homo sapiens
  misc_feature: GYAE6OF01DORB0.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatacggctccgacaacaagaactactagcttggtatcagcagaaaccaggacagcctctaaactgctcattaactgggcatctacccggcaacgtccggggtccctgaccgattcagtggcagcggtctgggacagatttcactctcaccatcagcagcctgcaggctgaagatgtgctagtttatactgtacaatagtttcgtcgggtcgttcggaccgaagggaaccgaagggtagtaaacgtaacgaaacgtaactagtaggctgaccaccaacgtcttgtcttcgtacttcttcccgtcctactactacgaacgtacgtaacg

SEQ ID NO: 16688 - DNA, 513 bp, Homo sapiens
  misc_feature: GYAE6OF01A667O.9.12.B01.1.454.CMB.1.raw
  modified_base (235)..(235): a, c, t, g, unknown or other
  misc_feature (235)..(235): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaatccgggtccctgaccgattcagtggcagcgggtctgggacagatttcactctcaccatcagcagcctgcaggctagaagatgtggctagtttattactgtcaacgtgttttctcgggtcgttcggaccaagggaccaaggtacggaaatacgaaacgactagtggctgcaccatctgtcttcgtac

SEQ ID NO: 16689 - DNA, 564 bp, Homo sapiens
  misc_feature: GYAE6OF01DJA22.9.12.B01.1.454.CMB.1.raw
  modified_base (292)..(292): a, c, t, g, unknown or other
  misc_feature (292)..(292): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgaacaaacaagaactacttagcttggtatcagcaagaaaccaggacagcctacctaaactgctacattaacgngggcatctacccggcaacgtccgggtcctgaccgattcagtggcagcggtctggacagtatttcactctcaccatcagcagcctgcagctagagatgtgctagtttactactgtactaactagttttcgcgggtccgttcggaccgaacggggaccgaaaggtaggaaacgtacaaacggtaactggttacggcgtgacctacctacgtcgttagttccttactacttcccttaccccgtacctaacttctaacggaaacggtcgtaaaccg

SEQ ID NO: 16690 - DNA, 620 bp, Homo sapiens
  misc_feature: GYAE6OF01BTB4C.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttatacggctcgacaacaagaactactagcttggtatcagacaagaaaccaggacacgaccctacctaaactgactctaattaacctgggacactaccgtaacccgcgaacgtcccggggtaccctagacccgatttccgaggtcggcgaggccgggtacgtaggggacaggtactttcaacttcctccaacctactacacgccgagccctagcgacggctaggaagagtggtaggacttagtttaattacgttacgtactaacttagtttccgcgggttacgtcggacgtaacgggtacgaaggtaaggtaaataaccgaaagtaacgtgacgtctagacctaccgtacgtcctagttccttactaccttcccgttaccgtaccctactaccagtaccggtaacgtaaccg

SEQ ID NO: 16691 - DNA, 544 bp, Homo sapiens
  misc_feature: GYAE6OF01ESE0M.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaacgtccgggtccctgaccgattcagtggcagcggtctgggacagatttcactctcaccatcagcagcctgcaggctagaagatgtggctagtttattactgtcaactagttttcgtcgggtcgttcggaccgaacgggaccgaaggtaggaaactacgaaacgtaacgtagtggctacgccacctaagtccgttgttccttcacttccttccccgtcctactactaggtaacgtacgttaac

SEQ ID NO: 16692 - DNA, 501 bp, Homo sapiens
  misc_feature: GYAE6OF01ETDLB.9.12.B01.1.454.CMB.1.raw
  modified_base (436)..(436): a, c, t, g, unknown or other
  misc_feature (436)..(436): n is a, c, g, or t
  modified_base (498)..(498): a, c, t, g, unknown or other
  misc_feature (498)..(498): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccgggtcctgaccgattcagtggcagcgggtctgggacagatttcactctcaccatcagcagcctgcaggctgaagatgtggctagtttatactgtcaactgttttcncgggtcgttcggccaagggaccaaggtgaaatcgaaacgaatggtgctgcaccatctgtctntac

SEQ ID NO: 16693 - DNA, 571 bp, Homo sapiens
  misc_feature: GYAE6OF01DVKQ7.9.12.B01.1.454.CMB.1.raw
  modified_base (235)..(235): a, c, t, g, unknown or other
  misc_feature (235)..(235): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcaagaaaccaggacagcctactaaactgctcattaactggcatcctacccggcaacgtcccgggtcctgaccgattcagtggcaggcgggtctgggacagtactttcacttctacaccatacagcagcctgacaggctagaagtatggtggactagttttattactgtactaacgttagttttcgtcggggtcgttacgggaccgaagggtacccgtaagggtacggtaaagtaaccgaaaacggtaactaggtcggacgtcgaccgtaacctacttacgtacgtttccgttctaccg

SEQ ID NO: 16694 - DNA, 516 bp, Homo sapiens
  misc_feature: GYAE6OF01D3AI3.9.12.B01.1.454.CMB.1.raw
  modified_base (392)..(392): a, c, t, g, unknown or other
  misc_feature (392)..(392): n is a, c, g, or t
  modified_base (469)..(469): a, c, t, g, unknown or other
  misc_feature (469)..(469): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggacagccctacctaaactgctcattaacgtgggcatctacccggcaacgtccggggtccctgaccgattcagtggcaggcgggtctggacagtatttcactctcaccatcagcacgcctgcaggctagaagntgtgactagtttatctgtctaactgttttcgcgggtcgttcgacgaacggaccgaaggtagaatacgaaacgactgnggtctgcactactctgtctctactccttcccgctatctgagtgtacg

SEQ ID NO: 16695 - DNA, 515 bp, Homo sapiens
  misc_feature: GYAE6OF01BPWF8.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctggggacagatttcactctcaccatcagcagcctgcaggctgaagatgtggcagtttattactgtcaactagttttctcgggtcgttcggccgtaagggacccgaagggtaggaaagttccaaacgaactgtggctgccaccatctgtcttcatccttcccgccatctgaagcgtac

SEQ ID NO: 16696 - DNA, 543 bp, Homo sapiens
  misc_feature: GYAE6OF01EYAIE.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcagcgggtctgggacagattcactctcaccatcagcagcctgcaggctgaagatgtggctagtttattactgtacaactgttttctcgggtcgttcggaccgaacgggaaccaagggtagaaacgtacgaaacgtaactaggtcggtacgtcgccaacccgtatccgttgtcttcacttccttccccgtctacttatcgtaaagtcgttaacg

SEQ ID NO: 16697 - DNA, 677 bp, Homo sapiens
  misc_feature: GYAE6OF01C9RQI.9.12.B01.1.454.CMB.1.raw
  modified_base (242)..(242): a, c, t, g, unknown or other
  misc_feature (242)..(242): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatcctcctgcactggaaccagcagtgactagttggtncttataactatgtctcctaggtaccaacacgacaccaggacaaacgtccccaaatcatgtattatgagtacaatacgcgtacctcgtcgggtccctgactcgtcttctcgtcggctacaagtctacggaccaacgaccggtccctcctcgtacccgtctcgtgggcctcgacggtctagacgtagtcggacggtactgtaactttattacgtcgacctacggtcttacgtaattacgtacggtaccgaccgggtaccctaacccgtaacgttaacgtttcggttaccggttaaccggggtaaacgggttccgggaaaccccgtacgggttacccgtaccccgggttaccgttaacgggttacccgaacccggtaccccgaaacccggtaaccccaaacccccgtagttacccggtacccttacccgttacccccg

SEQ ID NO: 16698 - DNA, 673 bp, Homo sapiens
  misc_feature: GYAE6OF01BFHEY.9.12.B01.1.454.CMB.1.raw
  modified_base (316)..(316): a, c, t, g, unknown or other
  misc_feature (316)..(316): n is a, c, g, or t
tcagtgatacgtctcacgaccggtgctcgatttagtagtgtagattccgcgggtcgagcaagactggtgttgcagacccaggtccttcatttctctcgttgctctggacttctctggtgccgtacggggacatcggtgatgaccctagttctccagactccctggctgtgtctccgtgggccgaggacgggcctaccgatcaactgcgtaagtccagccagagttgtttacacggctccgaacaacaagactagttagcttggtatcagctaagaaaccaggacagtacctacctaaactgcgtcaacgttaacgngggcctagtccgtacccggctaacgtcccggggtcctaggaccgtatttcgagtcgacgaggcgggtctagggacagtatttcactcacacgatcgtagcagcctagcaggtctagaacggtattcggtacggacttaagtttacttaccgttcgtaactaacgtttcgttttaccgtcggggttaccgttaccggaccggtaaacgggtaaccgtaaaggtaacggtaaacgtacccggtaaacgttacgtacgttacggtcgtacggaaccgtacccgtagtcccgtttagttaccttaccgtacgtttcccgtacccgtacgttaacttacgttacggtaacgttacgttaacg

SEQ ID NO: 16699 - DNA, 522 bp, Homo sapiens
  misc_feature: GYAE6OF01DQKNE.9.12.B01.1.454.CMB.1.raw
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggacagcctacctaaactgctcattaactggcatctaccggcaacgtccgggtcctgaccgattcagtggcagcggtctgggacagtattcactctcaccatcagcagcctgcgagctagaagtagtgtgctagtttattacgtgtactaacgtagttttcgtcgggtcgttcgacgaaggaccgtaaggtacggtaatacaacgaactgtggctgcacatctnttcttcctactttccgacctntactagaacgngtatacg

SEQ ID NO: 16700 - DNA, 592 bp, Homo sapiens
  misc_feature: GYAE6OF01BH6DV.9.12.B01.1.454.CMB.1.raw
  modified_base (218)..(218): a, c, t, g, unknown or other
  misc_feature (218)..(218): n is a, c, g, or t
  modified_base (516)..(516): a, c, t, g, unknown or other
  misc_feature (516)..(516): n is a, c, g, or t
tcagtgatacgtctcacgaccggtgctcgatttagtagtgtagattccgcgggtcagcaagatggtgttgcagacccaggtcttcatttctctgttgctctggatctctggtgcctacgggggacactcgtgatgacccgagtctccagacgttccctggctgtgttctctgggcgagagggccaccgatcaactgcaagtccagccagagtgtttanacggctccgacaacaagaactacttagctttggtatcagcagaaaccaggacagcccttacctaaactgctcattaactgggcatcctaccggcaacgtccgggggtccctgaccgattcgaggtcggacacgcgggtctagggacaggaatttacacgtctcacctatcagcagcctgacaggtctaggaagtagtcggtaggctaagttttattactgttactaacgtgttttcgacgggtacgttcggaccaagggaccaagggtaggaaactacgaaacgtacgtaggtacggntcgaccgtaaccgtagtccgtagttcgttcgtacttcccttcccggacctacgttccgtacgtaacgtcgttaacg

SEQ ID NO: 16701 - DNA, 552 bp, Homo sapiens
  misc_feature: GYAE6OF01BEC1C.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaaactgctcattaactgggcatctacccggcaatccggggtccctgaccgattcagtggcaggcgggtctgggacagatttcactctcaccatcagcagcctgcagggctgaagatgtggctaagtttattactgtctaactagttttctcgggtcgttcggccaagggaccaaggtaggtaaacgtacaaaccgtaactggtacggctcgaccaccagttctgttcttacctacttcccgttaccccgtcccacttaccgtacggtaaagtacgttaacg

SEQ ID NO: 16702 - DNA, 546 bp, Homo sapiens
  misc_feature: GYAE6OF01BW1EX.9.12.B01.1.454.CMB.1.raw
  modified_base (211)..(211): a, c, t, g, unknown or other
  misc_feature (211)..(211): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgaacaacaagaactacttagcttggtatcagcagaaaaccaggacagcctcctaaactgctcattaactgggcatctacccggcaacgtcccggggtccctgaccgattcagtgcagcgggtctgggacagatttcactctcaccatcagcagcctgcagctagaagntgtgntagtttattactgtactaactagttttcgcgggtcgttacggaccgtaagggaccgtaagggtagtaaataccgaaacgtacgtggtacggctcgacaacctacgtcttgtcttcacttcccgttacccgctactacgtacgaagtacgttaac

SEQ ID NO: 16703 - DNA, 559 bp, Homo sapiens
  misc_feature: GYAE6OF01DO8DL.9.12.B01.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttanacggctccgacaacaagaactacttagcttggtatcagcagaaaccaggacagcctactaaactgctcattaacnggcatctacccggcaacgtccgggtccctgaccgattcgagtggcaggcgggtctgggacagtatttcactctcaccatcagcagcctgcagctagaacgntgtggctagttttactacgttgtactaacgttagttttcgacggggtccttacgggaccaaacggggacctaaagggtagtaaactaccgaaaacgtaaccgtaggtcggactacgactaccctattccgttgttccttcgtaaccg

SEQ ID NO: 16704 - DNA, 518 bp, Homo sapiens
  misc_feature: GYAE6OF01A1P5B.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttatactgtcaactagttttctcgggcgttcggcgaagggaccaagggtggaaactcgaaacgaacgtgtggctgacaccagtcttgtccttcactccttccccgcacttctacgaacgcgtaac

SEQ ID NO: 16705 - DNA, 559 bp, Homo sapiens
  misc_feature: GYAE6OF01CAE34.9.12.B01.1.454.CMB.1.raw
  modified_base (483)..(483): a, c, t, g, unknown or other
  misc_feature (483)..(483): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctctaaactgctcattaactgggcatcacccggcaagtcccggggtccctgaccgtattcagtggcaggccgggtctgggacagtatttcactctcaccatcagcagcctgcaggctagaagagtgtgctagtttattactgtacaactgttttcgtcggtcgtcggacgaacgggaccgtaaggtacggtaaactacgaaacgtaacgtgtacggtntacgccaacctagttctcggttcttacctacttcccgttccccgtacctacttaccgtaagtaacgtacgttaacg

SEQ ID NO: 16706 - DNA, 750 bp, Homo sapiens
  misc_feature: GYAE6OF01CGOUH.9.12.B01.1.454.CMB.1.raw
  modified_base (286)..(286): a, c, t, g, unknown or other
  misc_feature (286)..(286): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtggggcgaggagggccaccatcaactgcaagtccagccagagttgttttatacggctccgacaaacaagaactacttagcttggtatcagcaagaaaccaggacagcctacctaaactgctnattaacgtggcatcctaccggacaacgtccggggtccctagaccgtattccgaagtcggcgaggtccggggtcgtacggggaacaggtactttccgaacttcctaccaaccctataccgaacggcctaacggtcccgttaggacgtacgggtaccgttaagggaaaggtagttacgggttacgggtaccgtttaaaggtttttaaccgtttaaccttacgggttaacctaaaccggttttacggttttttacccggtacccgggggtttccggtttaacccgggaacccggtaaacggggtaacccggtaagggtaacgggtaaaacgttaaccggaaaacgtaaccggttaggtacgggtcctacggaccgtaacccgtagtccgttaccgttaccttttaccgaccgtttccccttaccccggcccttaacgttacccgtacggtaaacgtaccgttaaccg

SEQ ID NO: 16707 - DNA, 653 bp, Homo sapiens
  misc_feature: GYAE6OF01CTBYW.9.12.B01.1.454.CMB.1.raw
  modified_base (216)..(216): a, c, t, g, unknown or other
  misc_feature (216)..(216): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatgacccagtctccagacctccctggctgtgtctcgtgggcgaggagggccaccatcaactgcaagtccagccagagttgttttanacggctaccgaacaaacaagaactactagcttaggtatcagacaagaaaccaggacacgcctactaaactgctactaattaacgtgggactacgtccctacccggactaaccggtcccggggtaccctacggaccgtatcgaggtcggacgaggtccgggtactggggaactagtactttccactctcaacgatcgacgcacgcctagcgaggtctaggaagagttggtacgtacgttaagttttactacttcgtaacctaacgttcggttttccggcgggttcggtaccgggtaaccggaacgggtaaccggtaagggtaacggtaaacgtaaccgaaacgtaccgtaggtacggtcgtacgaccaccgtacgttccgtcgttacctttcgccttacccgttcccgtacctacgttacgacgtaaggtaactaccg

SEQ ID NO: 16708 - DNA, 505 bp, Homo sapiens
  misc_feature: GYAE6OF01A3QKZ.9.12.B01.1.454.CMB.1.raw
  modified_base (286)..(286): a, c, t, g, unknown or other
  misc_feature (286)..(286): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaacngggcatctacccggcaactccggggtccctgaccgtattcagtggcaggcgggtctgggacagatttcactctcaccatcagcagcctgcaggctagagatgtggctagtttatactgtacaactgtttcgcgggtctcgaccgaaggaccaggtagtaaatacgaaacgactgtgctgcaccatctntcttcatccttcccgcactcngaagtcgtac

SEQ ID NO: 16709 - DNA, 758 bp, Homo sapiens
  misc_feature: GYAE6OF01DB436.9.12.B01.1.454.CMB.1.raw
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
tcagtgatacgtctcacgaccggtgctcgatttagtagtgtagattcggcgggggggtctcaggaggcagcgctctcaggacgtcaccaccatggcctgggctctgctcctccccaccctcctcactcagggcacagggtcctgggcccagtctgccctgactcagcctccctccgcgtccggtctcctggacagtcggtcaccatcctcctgcactggaaccagcagtgacattggtnctttanaactntcgtctcctggtaccaacagcaccaggacaaacgtccccaaaactcatgatttagngagtcaagtaacgccgccctcgtcgggtccctgtatcgtcttctcgtacggtcctaccgaaagtctcgggaccaaccgaccggtcccttcccgtcggtaccccgttccttccgtcggggtccctacccggtaacggtccgttacggaaccgtagttacgggtacggtccttaggttaacttttaacgttacgttggtacctacggttacccttactaagtttaacgttcggaccgaaccgggtaccccaaaccccgtaaacgtaagtttaccgtttaccggtttaccgggtaaacggggttacccgggtaaaccccggtaccgggttacccgtaaccccggtttacccggttaacgggtaaccccggtaccgaaccccccggtaaacgggtacccccctaaaccccccgttaacttcccgggttaacccaccccgtttccgttaccccccgg

SEQ ID NO: 16710 - DNA, 524 bp, Homo sapiens
  misc_feature: GYAE6OF01CZIZC.9.12.B01.1.454.CMB.1.raw
  modified_base (390)..(390): a, c, t, g, unknown or other
  misc_feature (390)..(390): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaacgtccggggtcctgaccgattcagtggcagcggtctgggacagatttcactctcaccatcagcagcctgcaggctagaagatgtggntagtttatactgtactaactgttttcgtcgggtcgttcggacgaagggaccgaaggtaggtaaactacgaaacgtaacgtgtaggctgaccacacttcgtgttcttctactcctcccgccatctagagcgtaac

SEQ ID NO: 16711 - DNA, 723 bp, Homo sapiens
  misc_feature: GYAE6OF01EK2O4.9.12.B01.1.454.CMB.1.raw
  modified_base (212)..(212): a, c, t, g, unknown or other
  misc_feature (212)..(212): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctaccgaacaacaagaactacttagctttggtatcagacaacgaaaccaggacacgaccctacctaaactgacctactaattaacgtgggactacttacccgtacccggacctaaacggttccccgggggtaccctacggacccgtatttaccgaggtcgggaccgacgggtccggggtcgtaggggaactaaggttactttccaacttcctaccaaccgtactaccgaacggccaacgtcccgtggaccgacgggtaccgttaggaaggtagttggtcggtacttaagttttacttacgttacgttactaaacgtttacggttttccgtcggggtaccgtttaccggacgaacgggtaacgtaacgggtacggtaaactaaccgtaaacgtaacgtacggtacgtacgtacggacctaacctaacgttccgttacgttaccttaccgtaccgttccccgttaaccccgtcctaacgttaccgttacggtaaacgtaccgttaaccg

SEQ ID NO: 16712 - DNA, 609 bp, Homo sapiens
  misc_feature: GYAE6OF01A9PEH.9.12.B01.1.454.CMB.1.raw
  modified_base (292)..(292): a, c, t, g, unknown or other
  misc_feature (292)..(292): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgaacaaacaagaactacttagcttggtatcagcaagaaaccaggacagcctacctaaactgctcattaacgnggcatcctacccggcaacgtcccggggtccctcgaccgattcgaggtcggcgaggccgggtctgggacagtatttcactctcacatcagcagcctgcgaggctaggaagtagtggtggtacttaagttttacgttactgttaccaacgtttcggttttccgtcggggtccgttccggaccggtaaacgggaaccgtaagggtaacgtaaacgtaccgtaaaacgaacgttggtacggcgtacgaccgaccgtactcgttacgttcctttcacctcccgttaccccgtacctacttacgtacgaacgtacgttaaccg

SEQ ID NO: 16713 - DNA, 519 bp, Homo sapiens
  misc_feature: GYAE6OF01CSIQ0.9.12.B01.1.454.CMB.1.raw
  modified_base (211)..(211): a, c, t, g, unknown or other
  misc_feature (211)..(211): n is a, c, g, or t
  modified_base (515)..(515): a, c, t, g, unknown or other
  misc_feature (515)..(515): n is a, c, g, or t
tcagtgatacgtctcacgaccggtgctcgatttagtagtgtagattccgcgggcagcaagatggtgttgcatacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaactccggggtccctgaccgattcagtggcagcggtctgggacagatttcactctcaccatcagcagcctgcaggctgaagatgtggctagtttattactgtacaactagttttcgtcgggtcgttcggaccgtaagggaccgaagggtaggaaatacaaacgaactgtaggctcgcacatctgtcttcactcttcccgctatagaacgtcgtntacg

SEQ ID NO: 16714 - DNA, 541 bp, Homo sapiens
  misc_feature: GYAE6OF01DPCP0.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcaagaaaccaggacagcctacctaaactgctcattaactgggcatcctacccggcaacgtcccggggtccctgaccgtattcagtggcagcggtctgggacagattcactctcaccatcagcagcctgcaggctagaagatgtggactagtttactactgtactaactgttttccgcgggtcgttcggccgaagggacaagggtaggtaaatacgaaacgaactgtacggtctcgcctaccacgtctgttcttactacttcccttacccgtctactcgtacgaagtcgtaac

SEQ ID NO: 16715 - DNA, 699 bp, Homo sapiens
  misc_feature: GYAE6OF01BTU1L.9.12.B01.1.454.CMB.1.raw
  modified_base (315)..(315): a, c, t, g, unknown or other
  misc_feature (315)..(315): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacgagggtcctgggcccagtctgccctgactcagcctcctccgcgtccggtctcctggacagtcggtcaccatctcctgcactggaaccagcgagtgactagttggtgtacttaataacttatgttcctccgtcggtaaccaacgagaccacccgaggacaaacgtaccccaaactcactntattataggagttacaataacgccggtcctcgtcgggtcctagtactcgtcttctcgtcggtctaccgtaagtctacggacaaccgaccggtcccttcccgtacggtaccgttccgtcggtcggggtcctaccgtaggtccgtacggacgtagtcgggaacgtccttaggtaactttaacgtttacgcggtacctaacgtcttacgtaacttaggtaccggtacccgaaccggaccctaaacccacgttaacgttcgggttaccggttaaccgggaagggttaaccgggacccttacgggtacccgtaccgttccgggtacgtaccgacccgaacccgaacccggtacccccaacccgtagtcgttcccttaacccgttcccgg

SEQ ID NO: 16716 - DNA, 699 bp, Homo sapiens
  misc_feature: GYAE6OF01A3Q74.9.12.B01.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacggctaccgacaacaagaactacttagcttggtatcagcaagaaaccaggacacgcctacctaaactgactcaattaacgtgggacactaccgtaccccggacgtaacgtccccggggtccctacggaacccgtatttccgaggtcgggaccgtacgggtccgggttacgtaggggaacctaggtacttttccaaccgttcctacccaaccctacgtccgaacgaccacggtcccgtacggaccgtacgggccgtaaggtaaaggtacgttagggttacggtacgtttagttttaacgtttacgttcgttaacctaaacggtttacgggttttccggtaccggggttccggttaccgggaccggtaacgggaaccggtaagggtacggtaaacgtaaccgaaacggtacgtggtcggaccgtacgaccgtacctacgttacgttcgttccgttcttacccg

SEQ ID NO: 16717 - DNA, 562 bp, Homo sapiens
  misc_feature: GYAE6OF01D0WZP.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaaacaagaactacttagcttggtatcagcaagaaaccaggacagcctcctaaaactgctcattaactgggcatccgtacccggcaacgtccggggtcctgaccgattcagtggcaggcgggtctgggacagtactttcactctcaccatcagcagcctgcaggctagaagatggtgactagtttactactgtacaacgtgttttcgtcgggtcgttcggaccgaacgggaaccgaaggtacggtaaataacgaaacgaacgtagtcggcgtacgccaactactcgttgttacttcgtacttccttccgtaccgtacctattccgtagtaaacggtaaccg

SEQ ID NO: 16718 - DNA, 631 bp, Homo sapiens
  misc_feature: GYAE6OF01BPQ0S.9.12.B01.1.454.CMB.1.raw
  modified_base (240)..(240): a, c, t, g, unknown or other
  misc_feature (240)..(240): n is a, c, g, or t
  modified_base (305)..(305): a, c, t, g, unknown or other
  misc_feature (305)..(305): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcggtcaccatcctcctgcactggaaccagcagtgacattggtncttaataactatgtctcctggtaccaacagcacccaggacaaacgtccccaaactcatgatttangagtacaaataagcgcctcgtcgggtccctgatcgtcttctctgctacaagtcctggtacaacgaccggtcctccgtcgtaccgtctcgtcgggctaccgaggcgtagacgtatcggaggtctagtatttatacgtgacacgtctacactaagtcggaccaacggaccctaaccccgtaataacgttccggttacgttaaccgggaaaggttaccgggaacccgttaaaacgggttcccaacccgggttccgttaacgggtcccgaaccggtaccccgaaaacggtccccctaaaccccttagtaccgttaccgtacccgttaccc

SEQ ID NO: 16719 - DNA, 558 bp, Homo sapiens
  misc_feature: GYAE6OF01BOANS.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctctaaactgctcattaactgggcatcctacccggcaagtcccggggtccctgaccgattcgagtggcaggcgggtctgggacagtatttcactctcacctatcagcacgcctgcaggctagaagatgtggatagtttattactgtactactagtttcgcgggtcgtcggacgaacggaccgtaagggtacgtaaataccgaaacgtacgtaggtcgcgtacgcctaaccgtacgtccgtagttccttctacttcccttccccggcttactcgtacgtaacggtacgttaccg

SEQ ID NO: 16720 - DNA, 573 bp, Homo sapiens
  misc_feature: GYAE6OF01BRJJB.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctaccgaacaacaagaactacttagcttggtatcagcaagaaaccaggacacgcctacctaaactgctacattaactggcatctacccggcaacgtccgggtcctagaccgattcagtgcaggcgggtctgggacagtactttcgactctacacatcagcagcctgcgagctagaagtactggtcgactaagtttatacgtagttactacttacgtttcgcgggtcgttacggaccgaaagggtaccgtaaggtagtaaactacgtaaacgtaactaggtcgactcgactaacctgtaccttgtccttctacttcccgttacccgtactacgtacctacgtaaaccgttcgtaaccg

SEQ ID NO: 16721 - DNA, 593 bp, Homo sapiens
  misc_feature: GYAE6OF01DO1EH.9.12.B01.1.454.CMB.1.raw
  modified_base (433)..(433): a, c, t, g, unknown or other
  misc_feature (433)..(433): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (526)..(526): a, c, t, g, unknown or other
  misc_feature (526)..(526): n is a, c, g, or t
  modified_base (542)..(542): a, c, t, g, unknown or other
  misc_feature (542)..(542): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctcgtgggcgagagggcccaccatcaactgcaagtccagccagtagttgttttatacggctccgacaaacaagaactacttagcttggtactcgagcaagaaaccgaggacacgacctacctaaaactcgcctacaatttaacgtgggacctacgtcccgtaaccccgggaccgaacgttccccgggggtccctacggaaccggtactttacgaaggttcggacgtagggtccggggtcgtacgggactaggtactttcacgtctacaaccntacagcagtccctagcgaggctagaagngttgtgtctaagtttatacgtntactacgtgtttcgcggtgtcgacgaaggacgaaggtagtaanacaacgagtcgtgacncgacactacgtcttntcttcnctccgttccctcactactcgtaagtcgtac

SEQ ID NO: 16722 - DNA, 536 bp, Homo sapiens
  misc_feature: GYAE6OF01D35O7.9.12.B01.1.454.CMB.1.raw
  modified_base (212)..(212): a, c, t, g, unknown or other
  misc_feature (212)..(212): n is a, c, g, or t
  modified_base (504)..(504): a, c, t, g, unknown or other
  misc_feature (504)..(504): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctccgaacaacaagaactacttagcttggtatcagacaagaaaccaggacagcctacctaaactgctacattaactgggcactcctacccggcaacgtcccggggtccctgaccgtatcagtggcaggcgggtcgtgggacagtactttcacctctacaccatcagcacgcctgcgaggctagaagtagtggtaggactagtttattacgtagtacaacttgtttcgtcgggtcgttcggacgaaggacgaggtagaatacaaacgactggagctgaccacactcgtntcttcactctccctcatacgtcgagtcgtacg

SEQ ID NO: 16723 - DNA, 779 bp, Homo sapiens
  misc_feature: GYAE6OF01DS5PV.9.12.B01.1.454.CMB.1.raw
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctcgtgggcgaggacgggccaccatcaactgcaggtccagccagagttgttttanacggctacgaacaacaagaactacttagcttggtatcagacaagaaaccaggacacgcctacctaaactgctactaagttaacgnggcacgttaccgtacccggactaaccggtcccggggtaccctacggtaacccgtatttcgaaggtcggacgacggtccgggtcgtacggggaactaggttactttacgaccttactaccaacctactccgaaacggtccgaacggtcccgtagaccggtaacgggtaccgtaaggtaacgtacgttacgggtacggttacgtttaaacggttttaacgttaccgttacggttaaccttaaacggtttaccggtttttacccgggttccggggtaaccggtttacccggggaacccggtaaaccggggtaacccgggtaaagggttaacggtaaaacgttaaaccggtaaaaccggtaacggttacgggttacggtaccgtacgtaacccgtaacgtacggttccgttacgttaccttacgtacccgtttacccgtcccgtaccttacttaaccggtacggtaaacggtccttaaccgg

SEQ ID NO: 16724 - DNA, 675 bp, Homo sapiens
  misc_feature: GYAE6OF01BJP71.9.12.B01.1.454.CMB.1.raw
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagacgggccacatcaactgacaagtccagccagagttgttttanacggctccgaacaacaagaactactagcttggtatcagcaagaaaccaggacagcctacctaaactgactcattaacgngggacactccgtacccggcaacgtcccggggtccctacgaccgtattcgagtcggcgaggccgggtcgtgggaccagttactttcgactcctacacctactacgacgcgacgtcctacgcgacggtctaggtaaggagttcgggtacggtacgttaagttttaacttacgttacggtacctaacgtttacgttttccggttacgggttccggttaccgggtaaccgggaacgggtaacccgtaaggggtaaccggtaaacgtaaccgtaaaccggtaacgttacggtacggtacgtccgacgtaccgtaacgttcgtacgttaccttccgtacgttcccgtaccccgtacctacgttaccgtacggtaacgtaccgttaaccg

SEQ ID NO: 16725 - DNA, 505 bp, Homo sapiens
  misc_feature: GYAE6OF01EIDT5.9.12.B01.1.454.CMB.1.raw
  modified_base (418)..(418): a, c, t, g, unknown or other
  misc_feature (418)..(418): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaacgtccggggtccctgaccgattcagtggcagcgggtctgggacagatttcactctcaccatcagcagcctgcaggctagaagatgtggctagtttatactgtcaacgtgttttcncgggtcgttcggacgaacgggaccaaggtagaaatacgaaacgactgtgctgcacatctgtctcactcctcccgcatctgagcgtac

SEQ ID NO: 16726 - DNA, 705 bp, Homo sapiens
  misc_feature: GYAE6OF01EGE7E.9.12.B01.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagtgatacgtctcacgaccggtgctcgatttagtagtgtagattccggtcgggcagacaagatggtgttgcagacccaggtaccttcatttctctgttgctctggatctcgtggtgcctaggggacatcgtgatcgacccagtctccagacctcccgtggctgtcgtcctcgtgggcgaggcgggccaccatcaactgacaacgtccagccagtagttgtttacncgctaccgaacaacaacgtactactagtcgttggtatcgacgacaacgaaaccaggaccagtcctactaacgnactactagttaacgnggacaactaccgtaaccgacgtacggtcccgggtcctacggaccgtagtaccgtacggtcggacgtacgggtcgggttaccagggactaacgttctttaccaccgttacctaccgaacctacgtaccaacggacacgtacccgtcgaacggacgtaccagtaacgtacgtggttacgactttaagtttacgtacgttacgtacgtaaccgtttcggtttccggtccgggtacgtaccgggtaacgtaacgggtaaccgtaacggtacgtaaactaaaccgtaaacgttaggacgttacggacgaccgtaccaaccgtagttccgtcttaccgtcctacccggttccgtaccccgtcgtaccgttacttaccggtaacggtccttaaccgg

SEQ ID NO: 16727 - DNA, 694 bp, Homo sapiens
  misc_feature: GYAE6OF01CVW4Z.9.12.B01.1.454.CMB.1.raw
  modified_base (217)..(217): a, c, t, g, unknown or other
  misc_feature (217)..(217): n is a, c, g, or t
  modified_base (285)..(285): a, c, t, g, unknown or other
  misc_feature (285)..(285): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcggtgatgacccagtctccagactccctggctgtgtctcgtgggcgagagggcccaccatcaactgacaagtccagccagagttgttttanacggctccgacaacaagaacttacttagcttggtatcagacaagaaaccaggacagcctacctaaacngactcattaacgtggactactcctacccggactaacgtcccggggtccctgaccgtattcgagtgggcagggcggtcgtagggactagtactttacacttcaccaccacgtcgaacgcagcccgtgaccgtaggcttaaggaagtagtggtaggtaccttaagttttacttacgttaggttaaccgtaaacgttacggtttttaccggtccggggtccggtttaccgggaacccggtaaaacggggtacccggtaaaagggtacggtaaacgtaacgtaaaacccggtaacggttcgggtacggacccgttacgacccgtacccgttaaccgtttccccggttactttcgtaaccttccccgttaccccgactaccgttaactacggtaaacgtaccgttaccgtaccg

SEQ ID NO: 16728 - DNA, 518 bp, Homo sapiens
  misc_feature: GYAE6OF01BVQOB.9.12.B01.1.454.CMB.1.raw
  modified_base (392)..(392): a, c, t, g, unknown or other
  misc_feature (392)..(392): n is a, c, g, or t
  modified_base (473)..(473): a, c, t, g, unknown or other
  misc_feature (473)..(473): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaaacaagaactacttagcttggtatcagcagaaaccaggacagcctacctaaactgctcattaactgggcatcctacccggcaacgtccggggtccctgaccgattcagtggcaggcgggtcgtggacagacttcgactctcacatacagcagcctgcgaggctgaagntggtgactagtttatactgtacaactgtttcgtcggtcgtcgacgaacggaacgtaggacgtaagtacaaacgatgacgtntcgcactgtctgtcttcactccgtcctctactgtagaagcgtacg

SEQ ID NO: 16729 - DNA, 803 bp, Homo sapiens
  misc_feature: GYAE6OF01EIUOD.9.12.B01.1.454.CMB.1.raw
  modified_base (296)..(296): a, c, t, g, unknown or other
  misc_feature (296)..(296): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactactagcttggtatcagcaagaaaccaggaccacgcctacctaaactgactacaactttaacgnggggaccactccgtaaccccggacgtaacgttccccgggggttacccctggtaacccgtatttccgaaggttcgggaccgacgggtccggggtacgtaggggaacctaaggttacttttccaaccttccgtaccaaccctagtccacggaccacggtaccctcggaccgtaacgggtcctaagggaagtagttgggttacggaccgtttaaggtttttaactttaccggttaggttaaccctaaaccggttttacggttttttacccggtcgggggtttacccgggtttacccgggtaacccgggtaaacgggggtaaccccggtaaaggggttaacggtaaaacgttaaccggaaaaccggttaacgttcgggtacggtaccgtaccggaccgtacccttaacgttccgtttacggtttaccctttaccgtaacccgtttaccccggtttaccccccgtaccttaacggtttacccgtaacgggtaaaccggttaccgttaaaccg

SEQ ID NO: 16730 - DNA, 671 bp, Homo sapiens
  misc_feature: GYAE6OF01A1IQX.9.12.B01.1.454.CMB.1.raw
  modified_base (212)..(212): a, c, t, g, unknown or other
  misc_feature (212)..(212): n is a, c, g, or t
  modified_base (295)..(295): a, c, t, g, unknown or other
  misc_feature (295)..(295): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagaggccaccatcaactgcaagtccagccagagttgttttanacggctccgaacaaacaagaactacttagcttggtatcagcaagaaaaccaggacacgcctacctaaactgctcaattaacgngggactacttcctaaccccggctaaacggttcccggggtccctagaacccgtattacgaggtcggcgaggtccgggtcgtacggggaactaggtacttttaccgaccttcctaccgaacctaatccgaacgccacgccctgaccgtaggcctaggaacgtagttggtacgtacttaagttttactacgttgtaacctaacgtttgtttccgcgggttacgttaccggacgtaacgggaacgtaaggtaagtaaacgtacgaaacgtacgtacgtcggacttcggacctaaccgtcgttaccgttcggttacccttcgtaacctttcccccgttacccgaccttacgttaccgtaacgtaaaccggtcgttaaaccg

SEQ ID NO: 16731 - DNA, 611 bp, Homo sapiens
  misc_feature: GYAE6OF01AQXU3.9.12.B01.1.454.CMB.1.raw
  modified_base (237)..(237): a, c, t, g, unknown or other
  misc_feature (237)..(237): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttanacggctccgacaacaagaactacttagcttggtatcagcaagaaaccaggacagccctacctaaactgctactattaacgtgggacatccgtacccggntaacgtcccgggtccngaccgattcagtgcaggcggtcgtgggacagtatttcacttctaccaccatcagcacgcctgcaggcctaggaagagtggtcggtacgttaagttttacttaacgttcgtactaaccgttagttttccggtccgggttaccgttaccgggaccgtaaacgggtaaccgtaacgggtacgggtaaaacgtaaccgaaaaccgtaacggtaggtacgggccgtacggcctaaccgtattaccgtcgttcgtttccctaccg

SEQ ID NO: 16732 - DNA, 625 bp, Homo sapiens
  misc_feature: GYAE6OF01AGOC3.9.12.B01.1.454.CMB.1.raw
  modified_base (239)..(239): a, c, t, g, unknown or other
  misc_feature (239)..(239): n is a, c, g, or t
  modified_base (340)..(340): a, c, t, g, unknown or other
  misc_feature (340)..(340): n is a, c, g, or t
tcagtgatacgtctcacgaccggtgctcgatttagtagtgtagattccggcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgttttanacggctccgaacaacaagaactacttagcttggtatcagcagaaaccaggacacgcctactaaactgctcattactgggcatcaccgcaagtccgggtccncgaccgatcgagtcggcaggcgggtcgtgggacaggtattccgactctccgaccactcagcacgccgtcgacgacggtcgtaggaaagtacgtggtcggtacgttaacgtttactttacgtcgttacctaacgttacggttttccggtaccgggttcggttaccgggacccgtaacggggtaaccggaagggtacggtaaaacgtaaccgtaaaaccggtaagttacggtcgggtccgtacggtaccgtaaccctacgttaccgttcgttccgttcgttaacccg

SEQ ID NO: 16733 - DNA, 886 bp, Homo sapiens
  misc_feature: GYAE6OF01CUOFH.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtcctccagactccctggctgtgtctcgtgggcgaggagggccaccatcaactgacaacgtccacgccagtagttgttttacgtacggcctaccgaacaaacaacgaacttacttagcttggtactcagcaagaaaccaggaacacgaccctacctaaactcgactactattaacgtgggacctacgtcccgtaccccggacctaaccggttccccgggggttaccctacggtaacccgttacgttaccgacggttcgggaccggtaaggggtccggggttaccggttacgggggaaccgttaaaggttaaccgtttttaccaaacccgttttccccaaccggtaaacccctacgttacccgaaccggtacctaaccgggtcccttaacgggacccggtaacgggtaccggtttaacggaaacgggtagtttcggggttacggttacgtttaaacggtttttaacgttttaacgtaccgtttaaaccgttaaacccgttttacgggttttttcccgggtacccgggggttaccggtttacccggggaacccggtaaacggggaaaccgggttaaacgggttaacgggtaaaacttaaccggtaaacgtaccggttacgggtacggtaccgttacgacccgtaaccgtacgttccgttaccgtttaccttacccgtaccgtttaccccgtttaccccgtaacccgttaacgttaccgtaaacgggtaaaccgttaacggttaacccgg

SEQ ID NO: 16734 - DNA, 776 bp, Homo sapiens
  misc_feature: GYAE6OF01EIHUE.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacgggacatcgtgatgacccagtctccagactccctggctgtgtctcgtgggcgaggacggccacatcaactgacaagtccacgccagtagttagttttagtaccggtctaccgaacaaacaagtaacctacttagtcgtttaggtatcagacaacgaaaccgaggacacgccctaacctaaactgctactaacttaacgtgggactacgtccgtacccggacgtaaccggtcccggggtaccctacggaaccgtacgttcgacggtacggacgacgggtcgggtcgtacgggactagttactttccgtactccgtaccaacctactacgacgaccgacgtccgtcgacgtaacggtaccgtaaggaaggtagttggtacggtaacgtttaagttttaagttaccgttacgtaaccttaaccgttttacgggttttaccggtccggggttaccggttacccgggtaaccggtaaaccgggggtaaccggtaaacgggtaacgggtaaaacgtaacccggtaaaacgtacggttacgggtcggtaccgttaccggtaccctaacgttaccgttccgttaccggtttacctttaccgttacccgttcccgttacccccggtacttaaccgttaccgtaacggttaaacggtacccgttaacg

SEQ ID NO: 16735 - DNA, 606 bp, Homo sapiens
  misc_feature: GYAE6OF01CGUUL.9.12.B01.1.454.CMB.1.raw
  modified_base (211)..(211): a, c, t, g, unknown or other
  misc_feature (211)..(211): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaaacaagaactacttagcttggtatcagcaagaaaccaggacagcctacctaaactgctcataactggcatctacccgcaacgtccggggtcctgaccgtattcaggtggcaggccgggtcgtagggactagtactttcacgtcctccaccataccgagtcacgtccgtgccgaggactagaagagttggtcggtcttaagtttacttacgtgtacctaagttacgttttccgtacgggtcgttaccgggaccgaaacgggtaacccgtaagggtacggaaataccgaaacgtaacgtggtacggntacgacctaccgtagtcttacgtcttaccacttcccttaccccgtcctacgttaccgtaacgtacggtaccgttaacg

SEQ ID NO: 16736 - DNA, 636 bp, Homo sapiens
  misc_feature: GYAE6OF01CESKR.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttatacggctccgaacaacaagaactacttagcttggtatcagcaagaaaccaggacagaccctacctaaactcgctctaattaacgtgggacacgtaccgtaccccggacgaaccgttcccgggggtccctacggaaccccgtatttccgaggtcggctacggcggggtctaggggacagtactttccgactcctacacatcacgcacgcctgcaggctaggaagtagtcggtgtactagttttacttacgtgttaacacgtttacgttttcgacgggttcttcgggaacgtaacgggaaccgtaaggtacggaactacgaaacgtacgtgtacggactagcccaaacgtcgttacctggtttaccttccgacctttccccgttacccggacccttacgttactaacggtaaacgtacggtaaccc

SEQ ID NO: 16737 - DNA, 783 bp, Homo sapiens
  misc_feature: GYAE6OF01BHSI7.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactcccgtggctgtgtctcgtggggcgagagggccaccatcaactgacaagtccagccagtagttgttttaatacggctaccgaacaaacaagaacttacttagtacttggtatacagacaagaaaccaggacacgtacctacctaaacgtcgcctactaacttaacgtggggacctacgttacccgtaacccggacgaaaccggttccccgggggtcccttacggaccgtacgtttaccagggttcggacgacggtccgggggttctacggggaactaacggtactttacctaccttacctaaccaccgtaactcgaacgacccaacggtcccgttaggaccgaacgggaccttaggaaacggtacgttgggttacggtaacgttaaggtttttaacttacggttacgttactttaaaccggtttcggtttttaccgggtccggggttaccggttccgggaaccggtaaagggtacccgtaaggggttaacgaaacgttaccggaaaccgtacgtacgggtccggacgttacgtacccgaaccgttaacgtcgtttcgttacccgtttacgtacccgtttcccggttaccccgtcgttaacccttacggttaacggtaaacgttaaccggttaaccg

SEQ ID NO: 16738 - DNA, 548 bp, Homo sapiens
  misc_feature: GYAE6OF01CP5ZJ.9.12.B01.1.454.CMB.1.raw
  modified_base (241)..(241): a, c, t, g, unknown or other
  misc_feature (241)..(241): n is a, c, g, or t
  modified_base (392)..(392): a, c, t, g, unknown or other
  misc_feature (392)..(392): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaaccatcaaactgcaagtccagccagagttgttttanacgggctccgaacaacaagaactacttagcttggtatcagcaagaaaccaggacagcctacctaaactgctacattaaactgggacactccgtacccgctaacgtccgggtcctcgaccgattcgagtcggcaggcggtcgtaggacagtnttcactctacacatcgagcagcctgacaggctagaagagtgtgggactagtttactacgtagtactaactcgtttcgtcggtcgtacggtacgaacggtacgaggtagaactacgaaacgtagtacgtggctacgcacgtatcgtcttcgtctacg

SEQ ID NO: 16739 - DNA, 551 bp, Homo sapiens
  misc_feature: GYAE6OF01DWBN6.9.12.B01.1.454.CMB.1.raw
  modified_base (234)..(234): a, c, t, g, unknown or other
  misc_feature (234)..(234): n is a, c, g, or t
tcagtgatacgtctcacgaccggtgctcgatttagtagtgtagattccgcgggggagctacaacaggcaggcaggggcagcaaaatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagacagaaaccaggacagcctacctaaactgactacaattaactgggacatacctacccggacaacgtcccgggtcctgaccgtattcagtcggacaggcgggtctgggacagtactttcacttctacacctatcagcagcctgacgaggctagaagatgtagctaagtttattactgtactaacttagtttcgtcgggtacgtcgacgtacggaacgtaaggtagaacgtaacgtaaacgtaacgtgtaggctcgacacctatctagttctctattcccg

SEQ ID NO: 16740 - DNA, 608 bp, Homo sapiens
  misc_feature: GYAE6OF01B69LK.9.12.B01.1.454.CMB.1.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (353)..(353): a, c, t, g, unknown or other
  misc_feature (353)..(353): n is a, c, g, or t
tcagtgatacgtctcacgaccggtgctcgatttagtagtgtagattccgcgggcgagcgaagatcggttgtttgcagtaccctaggtcttcagtttctcgtgttgctcctggatctctggtgccgtacggggacatcgtgatgacccagtctccagacctccctggctgtgtctcgtggggcgtaggagggccaccattcgtaactgcaagtcctagccagacgtgtttanacggctcgacaacaagtactactagcgttggtatcagcagaaaccgaggacacgtcctactaactcgactntatacgtggctagtaccgtccgacacgtccggtacctagactatgagtcgngcgcggtctggactagtacttcgactcgacacgtatcgacgcacgtcgacgtacgtacggactaaggaacgtagtcggtagtacgttagttttaactcgtacgttactaacgttcgttttcggtcgggtacgttccggacgtaacgggacgtaaggtacgtaactacgtaaacgtacgtagtacggtctacgaccgtagtcttacgtactcttacacttcccgtaccgtactacgtagtaacggtacgtagtacg

SEQ ID NO: 16741 - DNA, 686 bp, Homo sapiens
  misc_feature: GYAE6OF01B8LGR.9.12.B01.1.454.CMB.1.raw
  modified_base (210)..(210): a, c, t, g, unknown or other
  misc_feature (210)..(210): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacggctccgacaacaagactactagcttggatcagcagaaaccaggacacgcctacctaaactcgactactaattaacgtgggcacgtcctaaccccggcaacgtcccggggtccctaggaccgtattcgagtcggcgaggtccgggtcgtagggactagtactttcactcctacaacctacgtacacgccacgccgtcggacgaggtccgtaggaacgtagttacggtacggtacttaagttttaacgttacgttagttaaccgtaaacgtttacgttttccgtaccggggttacgtttccgggaaccgtaaacggggtaaccgtaaaggggttaacggtaaaacgttaaccgaaaacggttaacgttacgggtacggtacgtacggacctaaccgtagttaccgttaggtttaccttccgttaaccttcccgttaccccgacctacttaccgtaacgtaaccggtaacgttacg

SEQ ID NO: 16742 - DNA, 769 bp, Homo sapiens
  misc_feature: GYAE6OF01ERCOP.9.12.B01.1.454.CMB.1.raw
  modified_base (243)..(243): a, c, t, g, unknown or other
  misc_feature (243)..(243): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcacgccctccctccgcgtccgggtctcctggacagtcggtcaccatcctcctgcactcggaaccagcagtgacattggncttataactatgtctctggtaaccaacagccaccagacaaacgtccccaaactcatgtactttatggtaacggtacaaagtaacgccggtacccttcggtcggggttccctgtactcgtcttcgtcgtcggtacctaccgtaacgtcgtacggacctaaaccgaccgggccccttacccgtacggtacccgttccgtcgttacggggtccctccggtaacggtctacggaacgtagtacggtaacggtccgttaaggttaactttaacgtttaacgtcggtaccgtaccggttaccctacgtaacgtttaagtccggaaccgaacccgggtacccctaaacccggtaaaccgttaacgtttaccggtttaccgttaaccgggggtaaacggttcccggggtaacccgtaaacccgggttaccccgtaaccccggtttaccggtaacgggtccctaaccccggaacccgaaacccggaccccccttaaacccgtaacccgtccgttaacccgttccgttaacccccg

SEQ ID NO: 16743 - DNA, 538 bp, Homo sapiens
  misc_feature: GYAE6OF01EUU5B.9.12.B01.1.454.CMB.1.raw
  modified_base (212)..(212): a, c, t, g, unknown or other
  misc_feature (212)..(212): n is a, c, g, or t
  modified_base (394)..(394): a, c, t, g, unknown or other
  misc_feature (394)..(394): n is a, c, g, or t
  modified_base (519)..(519): a, c, t, g, unknown or other
  misc_feature (519)..(519): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttanacggctccgacaacaaagaactacttagctttggtatcagcagaaaccaggacagcctacctaaactgctcattaactgggcatcctacccggcaacgtcccggggtccctgaccgattcagtggcaggcgggtctgggacagtattcactctcaccatcagcagcctgcaggtctagaagngtgtcggtactagtttattactgtactaacgtagtttcgtcggtcgttccggacgaacggacgtaaggtagtaaagacaaacgacgtgtggctcgacactacgtctgtccttcactccttacccnctactactcgtaagcgtac

SEQ ID NO: 16744 - DNA, 687 bp, Homo sapiens
  misc_feature: GYAE6OF01EK6B9.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatcgacccagtctccagacctcccgtggctgtgtcctcgtgggcgaggacgggcccaccatacaactcgacgaacgtccacgccaagtgttgttttacgacggtcctaccgaacaaacaagtaacttacgttacgtcgttaggtactacgagacaaacggaaaccgaggaccacggtcccttaacctaaacgtcgtacctactaacttaacggtggacctacgtacccgtaccgacgtaccggtcccgggtaccacgtaccgtatcgaggtcgcgacgggtcggtcgtaggactagtacttccgacttcaccgacctataccgacgaccgtacgtcccgtaggaccgtaggactaggaaagtgtacgggtagtacgtttaactttagtaactacgtacttacgttgggtttcccgacgggttacgtaccggaaccggtaacggtaacgtaacgggtactaaagtaacgaaacggtagtacgtcggaaccgtcgaaccctaacgttcttaccgtccgtttctacccgttacccg

SEQ ID NO: 16745 - DNA, 780 bp, Homo sapiens
  misc_feature: GYAE6OF01AE8XU.9.12.B01.1.454.CMB.1.raw
tcagtgatacgtctcacgaccggtgctcgatttagtagtgtagattccgcgggcaggcaagatggtgttgcagacccaggtcttcatttctctgttgctctggatctctggtgccgtacggggacatcgtgatgacccagtcctccagacctccctggctggtgtctcgtgggcgaggacgggcccacctatcaactcgacaacgtccagccagtagttgttttaacgacggcctaccgaacaaacaagtaactacgttagcttaggatcgagacaacgaaccgagacacgcctacctaaactgactactaacttaacgtgggtacctacgtcccggtaaccccggcgtaaaccgggtttccccggggtacccctaggtaacccgtagtttccgaaggtcgggacgtacgggtccgggttcgtaggggaacctaggttactttaccaaccgttccactaacccatcgacgacgaccgtccgtacggacgaacggtacgtaagtaacgtaggttggtacgtactttaacgttttaacgtaacgttacgtaactaaaccggtttcgttttaccgggacgggttcccgtttaaccggaacccgggtaacgggttaaaccgaaggggttaaaccgtaaacggtaaaccggtaaaccggtaagttaccgggtaacgtaccgtacggtacctaaaccgtccgttacgttaccgttctttaccctccgttaacccctttcccggtaacctaccgttaaacgtggttaaaacccggttcgttaacccg

SEQ ID NO: 16746 - DNA, 673 bp, Homo sapiens
  misc_feature: GYAE6OF01EMCPZ.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagtagttgttttatacggctaccgaacaacaagaactacttagcttggtatcagacaagaaaccaggacagcctacctaaactgctacaacttacgtgggacactcctaacccggacaacgtcccgggtacctacgaccgtacttcgaggtcggacgacgggtcgggtcgtacggggaactacggtacttttccgaaccttccgtaccaaccctatccgagtccacgccgtgccgtacgggtacgtagaagtagttggttcgttacgttacgttttaacttacgttcgttaaccgtaacgtttacggttttccggtccgggttcggttaccgggacccgtaaacggggtaaccgtaaacgggtacggtaaaaccttaacggtaaaaccgtaaggttacggtcggtacgtacgaacctaccgtacttacgtttaccgttcgttccgtacccg

SEQ ID NO: 16747 - DNA, 705 bp, Homo sapiens
  misc_feature: GYAE6OF01ACEU9.9.12.B01.1.454.CMB.1.raw
  modified_base (218)..(218): a, c, t, g, unknown or other
  misc_feature (218)..(218): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatgacccagtctccagacctccctggctgtgtctcgtgggcgagacgggccaccatcaactgacaacgtccagccagtagttgtttanacggctccgaacaacaagtaactacttagcttggtatcagacaagaaaccaggacacgcctacctaaactgacctactaacgtttaacgcgggtacacttacccgtaaccccggacgtaaaccggttccccggggtaccctacggtacccgtacgtttaccgaaggtcggactacgggtccgggttacgaggaactagtactttcaactcgacacgtatacgagtcacgtcctagccgaggcttaaggacgtatacgggttacgactttaacggttttactaccgttcgtaaccgtaacgtttaaccggtttcgggtcccggggttaccgtttaccgggaaccggtaaacgggaacgggtaaaggttaaccgaaacgttaaccgaaaggtaacctgggtactacggctaaccctacgtacgtaccttgttacttacgacctttccccgacgtccttaacgtagtaaccggtaagttacgtaaacccg

SEQ ID NO: 16748 - DNA, 926 bp, Homo sapiens
  misc_feature: GYAE6OF01B6W83.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaacgtccagccagtagttagttttacgacggctaccgacaaacgaagaactacttagcttggtatcatacaagaaaccaggacagccctacctaaactcgctactaacgttaacgtcgggacctacgtaccgtacccccggactaaccggtcccggggttccccgtacggtaacccgtacgtttaccgaagggttcgggaccgtacggggtccggggttaccggtacgggggtaaccgtaacggttaacgttttcccgtaacctttcccgttaaccctaccccgttaaaccgtaccgtaaacggtccccgtaaccccgggtcccctttaaccgggaccggtaaccggggtacccggttaaagggtaaaaccgggttaaggtttaccggggttacgggttaaaccccggttttaagggtttttttaaaccttttaacccgggttttaaccggtttaacccgtttaaaaccgttttaccggggtttttttacccgggtacccgggggtttacccgggtttaccccggggtaaccccggtaaaacgggggtaaaccccgggttaaaacgggggttaaaccgggttaaaaaccggttaaacccggtaaaacggggttaaaccgttacgggggtttaccgggaccggttaacccggtacccgtaaaccccgttacgtttacgtttccggtttccgtttacccgtttaaaccccgg

SEQ ID NO: 16749 - DNA, 880 bp, Homo sapiens
  misc_feature: GYAE6OF01DZ6CQ.9.12.B01.1.454.CMB.1.raw
  modified_base (420)..(420): a, c, t, g, unknown or other
  misc_feature (420)..(420): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagacctccctggctgtgtctcgtgggcgaggacggccaccatacaactgacaacgtccacgccagtagttgttttacgaccggctaccgaacaaacaagaacttacttagtcgttaggtatcgagacaaacgaaaccgaggacacgtacctactaacgtgactactaacttaacgtggactacgtaccgtacccggacgtaaccggtcccgggtccctacggaccgtattcgaggtcggaccgtacgggtcggtgacgggactaggttcttaccncctaccgtaccaacctactacgacgtaccgacggtcccgtacggacggaacgggttacgtaagggtaagttcggttacgggtacggttaacgttttaacggttttacttaaccggttacgtttaaaccgttaacggtttttccggttttcccggggtcccggggtttaacccggtttaacccggggaaacccgggttaaaccgggggtaaaccccggttaaaaggggttaaaccgggtaaaaccgtttaaaacccggtaaaaccggggtttaaccgttcggggttaacgggtacccggttaacctaaccccgggttaaaccgtttacccgtttccgggttacccgtttaaccccggttttaccctaccccgggttttaccccccgtttacccccggtaaaccgtttacgttaaaccccgggtttaacgggtaaaaaccgttaccccggtttaaacccggg

SEQ ID NO: 16750 - DNA, 572 bp, Homo sapiens
  misc_feature: GYAE6OF01C2K4U.9.12.B01.1.454.CMB.1.raw
  modified_base (215)..(215): a, c, t, g, unknown or other
  misc_feature (215)..(215): n is a, c, g, or t
  modified_base (561)..(561): a, c, t, g, unknown or other
  misc_feature (561)..(561): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggggacatcgtgatgacccagtctccagacctccctggctgtgtctctggggcgagagggccaccatcaactgcaagtccagccagtagtgttttanacggtctaccgaacaacaagaactacttagcttggtatcagcaagaaaccaggacagcctacctaaactgctcattaactgggacatccgtacccggcaacgtccggggtcctggaccgattcaggtcggcaggtcgggtcgtagggacagtactttcactctcaccatacagcacgcctgcaggctagaagatgtggcttaagtttatactgtactaactagtttcgtcggtccgttcggacgaaacgggaaccgaggtaaggtaaactactaaacgaacgtggtacggtactcgaccactacgtctgttacttcctactcccgttacccgacctaattcgtaanaagtacgtaac

SEQ ID NO: 16751 - DNA, 818 bp, Homo sapiens
  misc_feature: GYAE6OF01CY4LJ.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacgggacatcgtgatcgacccagtctccagacctcccgtggctgtgtctcgtgggcgaggacggccacatcaactgacaacgtccacgaccagtagttagtttttaacgaccgggtctaccgaacaaacgaacgtaactacgttagcgttaggtactacgagacaaacgaaccgaggactacgaccctaacctaacgtcgcctacgtaacgttaacgcgggtacctacgttacccgacccggacgtaaccggttcccggggtaccctacgaccgtacgttcgaacggttcggccgaggtccggggtacgtacggggaactacggttacttaccgaaccttcctaccaaccgtactccgtaagacccgtacgtcccgaggaccgaggtaccgtaagtaagtacgtaggtacggtacgtttaacggtttacttacttacggttaaccttaacggttttaccgggtttacccggttacgggttaccggttacccgggtaaaccggtaaccgggtaaacgggtacgggttaaaacggtaaaccgtaaaccgtaaaacgttaccggttaggtaccggtaccgttacggaaaccctaaccggttacgttacgtaccggtttaccttaccggttacccgttacccccggttacccgttaaaccgttacccgtaaccggttacgtaaacccggtacgttttaaaccccgg

SEQ ID NO: 16752 - DNA, 749 bp, Homo sapiens
  misc_feature: GYAE6OF01C65CE.9.12.B01.1.454.CMB.1.raw
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (414)..(414): a, c, t, g, unknown or other
  misc_feature (414)..(414): n is a, c, g, or t
tcagtgatacgtctcacgaccggtgctcgatttagtagtgtagattcggcggggggggtctcagggaggcagcgctctcaggacgtcaccaccatggcctgggctctgctcctcctcaccctcctcactcaggcacgacgggtcctgggcccaggtcctcggccctgactcacgccctcccgtccgcgtccgggtctccgtggacgtacgtcggtcaccacgtcctccgtgccacgtacggaacccngcgtaagtcactagttggtntacgttaataacttatcgtacctccgtacggtaccaacgtacgaccaacctacggaccaaaccgtacccccaaactcaattacgtaatttagtggtaacgtacaaagtacggccgcccgtcgtcgggtcctgacgtccgcttcgtcnggtacctacgagttcgacgactaccgaccgtccttacccgtcgtacccgttcgtcgtcggacctaccggtaggctaggacgtagtaggacggtcttaggtactttacttacgacgtacacgttaccagtaacgttacgtacgtacggaacggcccctaaaccgtaacgtacgtttacgttacgggttaaccgggtaacgggtacccgggtaaaccggtaccgggtaccgttaaccccggttaacggtaaccgggttccaaccccgggtaacccgaaaccccggtaacccccgaaacccgtttaccggtacccttaacccgtccgtttacccccgg

SEQ ID NO: 16753 - DNA, 819 bp, Homo sapiens
  misc_feature: GYAE6OF01DC5P9.9.12.B01.1.454.CMB.1.raw
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
tcagtgatacgtctcacgaccggtgctcgatttagtagtgtagattccgcgggcagcaagatggtgttgcagacccaggtcttcatttctctgttgctctggatctctggtgccgtacgggacatcgtgatgacccagtctccagactcccgtggctgtgtctcgtgggcgaggacgggccaccatcaactgcaagtccagccagtagttgttttanacggcctaccgaacaacgaagaacttacttagcttggtatcagcaagaaaccgaggacacgcctacctaaactgactcattaacgnggacacgtccgacccggacgtaaccgttcccggggtccctacggaaccgtacgttacgaggtcggacgacgggtccggggttcgtaggggtactaagttaactttccgaaccttcctaccgaaccgacttaccgacgtaccgacgtcccgtcggaccgtacgggtaccgtaaggtaacgaggtttacgggtacggtacgtttaaaggtttttacctttacgttaacggttaacccgtttaacggtttaccggttttttacccgggtcggggttaccccgggtttaccgggaaccccgggtaaacggggttaaccccggtaaaggggttaaacccggttaaaaacgtaacccggttaaaaaccgggtaaaccggtttcgggtaaccgggttacccgtaccgggaacccctaaaccgttaccgtttacccgttttacgttccgttttaacccgtaaccttttccccgttaaccccgtaccgttaacgttacggtaacggtaacgttaccgttaacccg

SEQ ID NO: 16754 - DNA, 760 bp, Homo sapiens
  misc_feature: GYAE6OF01BHETQ.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatcgacccagtcctccagacctccctggctgtgtctcgtgggcgaggacggcccaccatcaactgacaacgtccacgccagtagttgttttagaccggctaccgaacaaacaacgaacttacttagcttaggtatcagacaagaaaccaggacagccctaacctaaatcgactactaacttaacgtgggactactccgtaaccccggactaaccggtcccggggtaccctacggaccgtattacgaggtcggcgacgggtcggggtcgtggggaaccaggtttacttaccgacctcctaccaacctactccgaacggtccacggcccgtagacgacggtactaggaagtcgttggtcggtattaacggttttaactacgttacggtaacttaaacgtttcggtttttaccggccggggtttaccggttaccgggtaaccgggaaacgggtaacccggtaaagggtaacgttaaaccgttaaaccgaaacggttacggttacggacggtaccgtaccggaccgtaacccgtacgtttccgttacgtttacccttaaccgttaccgtttacccccgttaccccgtaacccgttacctttaacgtaaccggtaaaccggttccgttaaacccgg

SEQ ID NO: 16755 - DNA, 698 bp, Homo sapiens
  misc_feature: GYAE6OF01DBGDL.9.12.B01.1.454.CMB.1.raw
  modified_base (240)..(240): a, c, t, g, unknown or other
  misc_feature (240)..(240): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacggccaccatcaactgcaacgtccagccagagttagttttanacggctaccgaacaaacaagaacctacttagacttaggtactacagacaacgaaaccgaggacctaacgccctaacctaaacgtcgtctactaacgtttaacgcgggactaacttacccgtaccccggactaaccggttcccgggtaccctacggtacccgtagtttaccgaggtcggactcggggtaccgggttcgtacggggaactacgttactttaccgacgttcctacctaacctcgtaacccaagcccgtaacgtcccgttacgacggacgggttactaaggtaacgaaggttcggtacggtatttaaggttttacttaacgtcgttactaacgtttagttttccggacgggttcgtttacggaccgtaagggaaccgtaaagggtaccgtaagaaccgtaaacggtagtggtacgcgttacaccgaacttactcttactccgttcttacccg

SEQ ID NO: 16756 - DNA, 866 bp, Homo sapiens
  misc_feature: GYAE6OF01DV9IV.9.12.B01.1.454.CMB.1.raw
tcagtgatacgtctcacgaccggtgctcgatttagtagtgtagattccgcgggcagcaagatggtgtgtttcagacccaggtcttcatttctctgttgctctggatctctggtgcctacggggacatcgtgatgacccagtctccagactccctggctgtgtctcgtgggcgaggagggccaaccatccaaccgtcgaacgtacacgacgacgagttagtttagttaacgccgtccgaaccgaacaaacgaacgtaacttacgtgttacgttagtactacgagaccgaaaacgaacggacgacgtaccgtacccttaacgtacgtctactaacgttaacgtacggcgactaccgttacccggtaaccgacgtacccgggtcccggtacgaccgtaacgttctaacggtggtaccggacggtacgggtccggtaggacgtaactacgttacctactacccttacacctaaacgtcgtaacgcgtaaccgtaccgttacccgaggtaccggtaacggtacgtaaggtaaaggttgggttaccggttacggttaaacgttttaacggtttaaccgtttaaccgttaccgttaaacgtttaccggttttttacccgggtttacccggggttaccggttacgggtttaaaccccgggaaccgggttaaaccgggttaacgggtaaacgggtaaacgttaaacgtaaaacccggttaaccggttaacgggtcgggtaaccggttccgtaaccgtaacccgtaacgtttacccgttacgttttaaccgtttccgtttaacccgttacccgtttaccccgttaccccgtaacttaccgggttaactaaacggggtaacctaccggtttaaaccg

SEQ ID NO: 16757 - DNA, 813 bp, Homo sapiens
  misc_feature: GYAE6OF01AP5F2.9.12.B01.1.454.CMB.1.raw
  modified_base (318)..(318): a, c, t, g, unknown or other
  misc_feature (318)..(318): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtcctccagacctccctggctgtgtctcgtgggcgaggacgggcccaccatcaactgcaagtccagccagtagttagttttacacggctaccgaacaacgaagtaaccttacgttagtcgtttggtatcgagacgaacgaaaccaggacagccctacctaaactgactactattaacgngggactacgtccgacccggacaaccggtcccgggtccctacggtaccgtattcggaaggtcggtcgacgggtccggggtacgtacggggtaactaggttactttaccgaccttccgtaccgaccctacgttaccgacggtacccgaacggtcccgttacggaccggtaacgggtccgtaacggtaaaggttcggttcgggtacgggttacctttaaacgggtttttacttaaccggttaccgttaaccgttaaaccggttttacccgggttttaccgggttccgggggtacccggtttaccggggaaccccggtaaacgggggttaacccggtaaggggttaaccggtaaaccgtaacccgggttaaaacggtaacggttcgggtaccgggtaccgtacggtaaccccgtagttaccggtccgttaccgttctttacccgtccgttacccgttccccgaccttacgttaccggtaacgtaacccgttaggttacc

SEQ ID NO: 16758 - DNA, 661 bp, Homo sapiens
  misc_feature: GYAE6OF01DLX4I.9.12.B01.1.454.CMB.1.raw
  modified_base (220)..(220): a, c, t, g, unknown or other
  misc_feature (220)..(220): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccatctccagacctccctggctgtgtctcgtgggcgaggacgggcccaccatacaactgcaaagtccagcagagttagttttanacggctaccgaacaaacaaagaactacttagcttggtacacagcaagaaacaggacagcctactaaactgactactaagttaacgtggacaacgtccgtaacccggactaaccggttcccggggtcctacgaaccgtattaccgaggtggaccgaggtcggtcgaggggtaacagttactttacacttaccaccactancgaacncacgtctacgacgacgagtaggaagtagtgtacggtacttaagttttaaactacgtagttaacctaaacgttagtttcccgacggggtacttcgggacggaaaccgggaaccgttaaggaaggtaaaacgaaacgtaaaccggtaacgtaaggtcggacgtacgactaaccgtactacgtttacccgttcactttcccgtcccgtaccctagtaccgtaattaaagccggttaacc

SEQ ID NO: 16759 - DNA, 841 bp, Homo sapiens
  misc_feature: GYAE6OF01DUF6C.9.12.B01.1.454.CMB.1.raw
  modified_base (305)..(305): a, c, t, g, unknown or other
  misc_feature (305)..(305): n is a, c, g, or t
tcagtgatacgtctcacgaccggtgctcgatttagtagtgtagattcggcgggggggggtctcaggaggcagcactctcaggacgtcaccaccatggcctggctctgctcctcctcaccctcctcactcagggcacgacgggtcctcgggcccagtctcgccctgactcacgccctccctccgcgtccggtctccgtggactagtcacgtccacctatcctcctgaccacgtggactcccggactaccgtggtaccggttttggttccgttttgtcttattcggttccttaccgtcggttaaccngaccgaaccgcccgtaacccggaaggaaaccgaaaaccccggtacccctaaaaccgttccgtttaccctttaagtaacggaaaccgtcccttaacgttaaccggggcccgtcccgtaacggtacgggtacccttcccgttagtacgtccgttccttccgtaccgtcggtcctaccggtaacgggtccgtaccggaaccctaaaccggtcccggtaccccttcccgtacggtaccccgttctccggtaccggtacctacccgtaccgccctacggtaacgtacggtcggtacgttaacgtttaattttacgttaccgtcgaccgtaacgtcgtaccttaatagtaccggtaccaacggaccctacctagtaacgttcgtacgtacggtacggtaccggtaacccgtaccggttaccgacccgttaccggtacggtaaccccgaccgggtaaccccctaaccccgggaacccctaaaccccggttacgtacccgttaacccgtaccccggtttcccgttcccccgggttacccccccg

SEQ ID NO: 16760 - DNA, 912 bp, Homo sapiens
  misc_feature: GYAE6OF01BTI3L.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtcgccgtacggggaatcgtgatcgacccagtctccagacctcctggctgtgtctcgtggcgagacggccaccatacaactgactaacgtccacgccagtagtttgttttagaccggtctaccgaacaaacaagtaaccttacttacgtcgttaggtactacgagacgaacgaaaccgaggacacgaccctaacctaacgtcgtacctactaacgttaacgtcgggacctacgttaccgtaacccggtaccgttaaccggtccccggggttaccctacggtaaccgtacgttaccgtaggcggtaaccggtacggggtccgggttacggtaaccgggtaacctaacggtttaaacgtttcctaaccgtttacccaacccgtaaccttaccggtaccgaaccgggtaccaacgtaccccggtaggaccgttaacgggtaccggtaaacggtaacgtaacggtttagggttacggttaaacgtttaacgttttaaccgtttaacccgttacggtttaacccggtttaaaccggttttacggttttacccgggttccggggtttacccggtttaaccgggaacccgggttaaaccgggtaaaccggtaaccgggttaaacggaaaccgtttaaaccggaaaccggtttaaaccggtcgggtaacgggtaccgtaaccggtaccgttaacccgttaaccgtacgggttttacccttacccgttaacccgttaccgttaccccccgttacccgggttacctaacccggtttacgaaaccgtacggttaacccgttaacgttaacccgg

SEQ ID NO: 16761 - DNA, 768 bp, Homo sapiens
  misc_feature: GYAE6OF01C7QYZ.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtcgccgtacggggacatcgtagatcgacccagtctccagacctccgtggctgtgtctcgtgggcgaggacggccacatacactcgacaacgtccacgccagtagttagttttaacgtaccggctaccgaacaaacgtaaacgtaacttacgttagtcgtttaggtactacgacgaacgaacgaaaaccgaggaaccacgtaccctaactaacgtgtacctactaacgttaacgtcggtacctaacgttcccgaacccggtaccgtaaccggttccccgggtaccctaggtaaccgtacttaccggaggtacggaccggtacggtcggggtaacgtacgggtaacgttacgttacctttcgacctttaccgaacctaacctagtaccgacggacctaaccggtccgtaggacgtacggacgttaagaagtacgttggttacggtaactttagtttaacgttacgtacgttaacgttaacgtttcggttttacggtaccgggttacggttaccggaacggttaacggaacgtaacggtaacgtaaacgtaaccgaacggtagttacggaccgtacgtacgaaaccttcgttacgtaccgtttcttactacccggttcctaaccccgcttaacgtcttaacgggaactagttcgtaaccgg

SEQ ID NO: 16762 - DNA, 707 bp, Homo sapiens
  misc_feature: GYAE6OF01DBDH0.9.12.B01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacaggtcggtcaccntcctcctgcactggaaccagcagtgactagttggtncttanaactntcgtcctctaggtaccaacngccaaccgagcaaacgtcccaaatcatagtatttagngtacgtacaaagtacgccggtcctcgtcggggtccctgacttccgtcttctctcggtcctacgaagttctaggaccaaccgaccggtcccttcccgtacggtacccgttcgtccgttcggggaccttacccggaggtacctagggaaccgtatcgggtaacggtccttaggttaactttacgttacgtcgacgtacggtaccttacgtaacgttagtacggaccgtaaccgggaccctaaacccgtacttaacgtttcggttaccggttagggtaaaccggtaccggggtaccctaacgggtacccgtaacccggttaccgttaacgggtacaacccggtaccccgaacggtacccccaaacccgttgttaccgtaccgtccgtttacccccgg

SEQ ID NO: 16763 - DNA, 674 bp, Homo sapiens
  misc_feature: GYAE6OF01CHSRG.9.12.B01.1.454.CMB.1.raw
  modified_base (220)..(220): a, c, t, g, unknown or other
  misc_feature (220)..(220): n is a, c, g, or t
  modified_base (470)..(470): a, c, t, g, unknown or other
  misc_feature (470)..(470): n is a, c, g, or t
  modified_base (607)..(607): a, c, t, g, unknown or other
  misc_feature (607)..(607): n is a, c, g, or t
  modified_base (618)..(618): a, c, t, g, unknown or other
  misc_feature (618)..(618): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgaccagtctccagacctcctggctgtgtctcgtgggcgaggaggcccaccatacaactgacaacgtccagccagtagttgttttaanacggcctaccgaacaaacgaacgtaacttacgttagacgttaggtatcagacaagaaaccgaggaacgacgtaccctacctaaactcgactaccgtaataacgtgggacctacttcccgtacccggactaaccggttcccgggtacccgtacgaccgtattacggacggtggccgtaaggtccggggtacgtaggactaggttactttcgaccttccacctaccagtacgacgccgaccgcgtacgacgnggacgtaagtaacgtggtcggtactacgttaagtttacttacgtagtaccgtaacgtttacgtttcgggtacggtccggttaccggaacgtaaggtaaccggtaaggtaacgaacttacggaaactcggtagtcggnttaccgctacngttcgtattactctaccgttaccttcccacttaactaccgagtaaccggcttaccg

SEQ ID NO: 16764 - DNA, 788 bp, Homo sapiens
  misc_feature: GYAE6OF01D1VY9.9.12.B01.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (758)..(758): a, c, t, g, unknown or other
  misc_feature (758)..(758): n is a, c, g, or t
tcagtgatacgtctcacgaccggtgctcgatttagtagtgtagattcggcggggggggtctcagggaggcagcgctctcaggacgtcaccacctatggccgtgggctctgctcctcctcaccctctcactcagggcacgagggtcctgggcccagtctggtccctgactctacgtcctcccgtcgcgtccggtctcctggacngtcgtcaccatctcctgcgactggaaccagcagtcgactagttgggtntactttaataacttntcgttcctccgtacggtaaccaactacgccaacccaggaccaaacgtacccctaaaactctatagtaactttagtacggtacggtaactaacgtaacggccggtacccttcggttccggggtaccctgtacgttccggtcctttaccgtcgtcgtaccttacgaacggtttcgacggtaaccaaccgtaccggtacccttcccgttacggtacccgttccgtacgggtcgggtaccctacccggtacggtacgtacggtaaccgtagtacggacgggttacttacggtaactttacgttaccgtcgtaacgtacgttctacgtaattacgtaccgtacgtaaccgtaaccaacccttaacgtaacgttcggtaccggttaacggtaaccgggtccggggtaacccctacgggttacccgtacccggtttaccgttacggtaacccgaacccgggtaacccctaaacccgggtaacccctaaaccccgggttnttaacccggttccctaaccgtttacccccg

SEQ ID NO: 16765 - DNA, 839 bp, Homo sapiens
  misc_feature: GYAE6OF01EVM8N.9.12.B01.1.454.CMB.1.raw
tcagtgatacgtctcacgaccggtgctcgatttagtagtgtagataccgcgggcagggcaaggatggtagttgcgagacccagggtcgttcatttctcctgttagctctcggatctactggtgtccgtacggggacatacggtgactgaccctagtcctccagacctaccctggctcgtcgtctcgtgggcgacgtacgggccgacctatacaactgcctaagtccgagccgtaggtagttgttttaacgacgggtccgtacccgtaactaaacgtaaaggtaaccttacgttacgtctttagggtacttcccaagtccctaaaccggtaaacccgaccgggaaccctaccggtacccgtaaccgtaaaaccgtccggacccttaccgtaaactttaaccgtccggggtacctaacgttacccggtaaccccggtacgtaaaccggtccccgggggtacccctacggtaaccccgtatttaccgaggttacgggacgacgggtccggtacgtacgggtactaggttacttcgacttccgtaccaacgtaacgtaccgaaggccgtaccgtccgtcgaccgacggtaccgtaggaagtagtggtacgggttacttaaggtttaactaccggtaccgtacccgtaacgttcggtttaccggtcgggttaccggttacgggaaccggtaacggggaaccgtaagggtacggtaaacgtaaccgtaaacgtaacgtacggtacggtacctacgtaccgtaaccgtacgtcctacggtaccttacgaaccgttcccgtacccgggtaacctacggttaccgtaaggtaaccgttacggttaacg

SEQ ID NO: 16766 - DNA, 759 bp, Homo sapiens
  misc_feature: GYAE6OF01CSPB0.9.12.B01.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (425)..(425): a, c, t, g, unknown or other
  misc_feature (425)..(425): n is a, c, g, or t
tcagtgatacgtctcacgaccggtgctcgatttagtagtgtagattcggcggggggggtctcaggaggcagcgctctcaggacgtcaccaccatggcctggctctgctcctcctcaccctcctcactcagggcacgagggtcctgggcccagtctgccctgactcacgcctccctccgcgtccggtctcctggacagtcgcaccntcctcngcactggaaccngcagtnactgttggnacttaanactatgtctcctagtaaccaacaacctaccccggacaaaccgcccccaaactcttgtcctttatagtacttgtacgtagttacgtccggcccttcgaggttacgtttctgtactcgtccttctccgtcggtacctccgtaagtccgtcggaccacccgaccgtccctccctacgaccctntccgttcgtccgggtcctccgaggtcgtagggacggacggtacgtccgttaggttaactttactttccgtagtacgtaacgtaaccgttaaaacgaaaacgggtaccgttaccgttccccgttaccggtttcggggttttccgggggtttaccgggggaccgggggttaaaccgtaacggggtttaccggaacccggttaccggtaaccgtacccggaccgtaccccgggtaacggtccccgttccccggttacccccggttacccggttacccgttacccgttccctttacccccggttaaccccctcccccgtcccgttaccgtaaacccgg

SEQ ID NO: 16767 - DNA, 785 bp, Homo sapiens
  misc_feature: GYAE6OF01DS8KP.9.12.B01.1.454.CMB.1.raw
  modified_base (161)..(161): a, c, t, g, unknown or other
  misc_feature (161)..(161): n is a, c, g, or t
  modified_base (271)..(271): a, c, t, g, unknown or other
  misc_feature (271)..(271): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggactagtcggtagatcgaccctagtctccaagcctcccgnggctgtgtctcgtgggcgaggacggaccacataccaacgtgacacgtccacgacaggtagttgtttacgcggacctaccgaagaaactaagaccttacgtagcgttgtanacgagacaacgaaaccgtaggacacgtcctaacctaaagtcgtaccttagtaacgttaacggtccggactaaccgttcccggtaccccggaactaaacccgggttccccggggttacccctaggtaaccccgttatacgggtcggttacgccggtacgggtccggttacggtagacgtacgttattacccgaacttccggtaacacgtactacggacgactccgaccgtagaccgtaaggtactaagggacgttagttacgggtacggttaaccgttaggttttaacgtccgtttaacggtaccgtaacgttttcgggtttaccggtccgggttcccggttaacggaacccgggtaacgggtaacgttaaggggaaccttaaacggtaacccgtaaaaggtacgggtacgtaaccgggtctaaccggttccctaaacccgttgtccgtttaccgtaccgttccgtaccgttcccgtaccgttaccgtacgttacgtaacgacggttctaaccgg

SEQ ID NO: 16768 - DNA, 729 bp, Homo sapiens
  misc_feature: GYAE6OF01DJRPD.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtcgccgtacgggacatcgtgatcgacccagtcctcagacctcccgtggtctgtcgtctcgtggcgaggcggccacatacaacgtcgacgacgtccagccagtagtttgttttacgaccggtcctaccgaacaaacgaagtaacttacgttagtcgtttaggtactacgaacgaccgaaacgaaaccgaacggaccaaccgtacccttaaccttaaacgtcgtacctacgtaacgttacggtcggactaccgtcccgtacccgacgtaccggttccccggtaccacgtacctcgttacgaggtacgcgtacggcggttcgacggactacgtacttcgaacctcgtaccactacgtacacggaccacgtccgaggaccgtagtaacgtaggaacgtagttcggttagtacgtttaacgtttaattacccgtagttaccttaggtttacgtttcggcgggttaccgtaccggaaacggtacgggaacgtaacggtaacgtaaaccgaaccgtacgtagtccggaacggttccaacggtccctacgtcgttttaccgtgttacccttaccttacccgtcccgttaccgaacgttcgtaacgttacgaaaccgttctaacccgg

SEQ ID NO: 16769 - DNA, 784 bp, Homo sapiens
  misc_feature: GYAE6OF01B9N8N.9.12.B01.1.454.CMB.1.raw
  modified_base (753)..(753): a, c, t, g, unknown or other
  misc_feature (753)..(753): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtcgccgtacggggacatcgtgatcgacccagtcctccagacctcccgtggctgtgtctcgtgggcgaggacggccacatcaactgacaacgtccagccaggtagttacgtttacgtacgctaccgaacaacaaagtaacttacttagtcttaggtactacaacgtacgaaacgaaaccgacggtaacaccgtaccctaacctaacgtctacctacgtaactttaacggcggtacctacgtaccccgtacccgggacgtaacccggtcccggggttacctaacggtaccgtaactttccggaaggtcggtacggacgggtcgggttcgtaaccgggacgtaagttacctttccaccgttacgtacccaaccgtacgtaaccgacgacgtacccgtcgacggaaccggtcggtaaccgtaaggtaacgggtcgttacggttaaggtaacgttttacgtttaaacgtacgttaacgttaaccgttaccggttttaccggggttttcgggacccggggtttccggaaccggaaccgggttaaaccggaaagggttacccgggaaaagtaaacggtaaccggtaaacggttcggttacgtcgggaccctacgtacccgttaacnccgtttacgtcttaacccgtctttcccccgg

SEQ ID NO: 16770 - DNA, 754 bp, Homo sapiens
  misc_feature: GYAE6OF01DA6E4.9.12.B01.1.454.CMB.1.raw
  modified_base (240)..(240): a, c, t, g, unknown or other
  misc_feature (240)..(240): n is a, c, g, or t
  modified_base (322)..(322): a, c, t, g, unknown or other
  misc_feature (322)..(322): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacaggtcctgggcccagtctgccctgactcagcctcctccgcgtccggtctcctggacagtcgtcaccatctcctgccactggaaccagcagtgaactagttcggngtacttataactatcgtccgtccgtaggtaccaacacgacacccgtaggaccaaaacgtccccaaatccagtcgtatttagngtacgtactaagtaacggccgtccgtacgtcgggtcctcgtacgtccgtacttctacgtcggtctacgtagtccgtacggacctaaccggtaccggtcccttcccgtacggtacccgttaccgttcggttcggggacccttacccggaaggtcccgttacgggtaacgtaggtacggtacgtaccgttaggttactttaacgttaaccgcgtactacgttcgtaacgtagttacggtcgaacgtacccgtacgtaaacccgtactaaacgtttcgttacgtaaccgggtaacggttccggggtaaacccgttacccggtacccgttacccgggtaaccgttaacggggtaccccaaccggtaacccccggttaaacggtaccccccgtaaaacccctaggtaaacccgttcccgtaaaccccgggtttcccg

SEQ ID NO: 16771 - DNA, 696 bp, Homo sapiens
  misc_feature: GYAE6OF01CUURC.9.12.B01.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (338)..(338): a, c, t, g, unknown or other
  misc_feature (338)..(338): n is a, c, g, or t
tcagtgatacgtctcacgaccggtgctcgatttagtagtgtagattcggcggggggggtctcaggaggcagcgctctcaggacgtcaccacatggcctggctctgctcctcctcaccctcctcactcagggcacgagggtcctcgggcccagtctcgccctgactcacgccctccctccgcgtccgggtctccgtggacagtcggtcaccatctcctgcacgtacggaaaccngcctagtcgaactagttggtntacttaatacgttatcgtcgtacctacggtaccaacacgccaaccgacggaccaaaacgtaccccaaactcatagtaactttanaggtaacgtactaaacgtaacggtccggtacccttcggtccggggtcctgtaactccgtcttctcgtcgcttacgaacgtcgtacggaccaacgacccggtccctccgtacgtaccgttcgtccggtcggtcctccggtacgccgttacgaacgtagtacgggtacgtaccgttagttaactttaacgttctacgactacgtctactatacgtcgaccgtaaccggaccctaacctaagtacgttaccggtacgttaacgggtacggtacggtaccgtaccgtccgtaaccggttcctaacggtcccgaaccggtacccaacggtaccccaaccgcgttacgtccctacgtttccccg

SEQ ID NO: 16772 - DNA, 862 bp, Homo sapiens
  misc_feature: GYAE6OF01DK7XR.9.12.B01.1.454.CMB.1.raw
  modified_base (172)..(172): a, c, t, g, unknown or other
  misc_feature (172)..(172): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctcagactcccgtggctgtgtctcgtgggcgagngggccaaccatcaactgacgaagtccacgccagtagttgttttaagtaccggctaccgaacaaacaagtaaccttacgttagtcttggtactcagccgaagaaaccgaggaacacgtaccctacctaaactgacctactacgttaactggggtaccaactcccgtaaccccggacgtaaaccggttcccgggggttacccctaggaacccgtacgtttacgacgggtacggaccgtaagggtccggggttcgtaacggggacttaacgggtacttttacctaaccttcctacctaacctacgttaccgaacgtcgtacggtacccttacgggaccgtaacggtccgttaagggtaaacggtacgttgggttacggttaacgtttaaacggtttttaacgtttaaccgttacgttaacgtttaacgtttaaccgggtttttccggttaccggggttaccgggtttacccgggtaaccggtaaaccgggtaacccggtaaaacgggttaaacgggtaaaaccgttaaaccggaaaaccggttaaaccggtttcgggtaaccggttacccgtaacggtaacccgaacccgttaacgttacccgtttacgtttacccttttcgaaaccgttttcccccgttaaccccgttaccgtaaacttccggtaaacgtaaacggttaaccgtttaaacgg

SEQ ID NO: 16773 - DNA, 669 bp, Homo sapiens
  misc_feature: GYAE6OF01EOVBL.9.12.B01.1.454.CMB.1.raw
  modified_base (221)..(221): a, c, t, g, unknown or other
  misc_feature (221)..(221): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctcgtgggcgaggcggccgaccaagtccaactgacgaagtccagccagtagttgttttanaccggctaccgaacaaacaagaacttactagcttaggtactcagacaacgaaaccaggacacgtaccctacctaaactcgactactaagtttaaccgtggggacctacgttacccgtaacccggacgtaaccggttccccggggtaccctaggtaacccgtatttcggaggtcggacgacggtcggggtctacgggaactaagtctttaccgaacttcctaccacgtactaccgaggccacgtcccgtagcgtacggtacgtaggaacgtaggttcgtacggtactttaaggtttaactcgtacgtactaacgtttagttccggtacggtcgtcggacgtaacggacgtaggtaacgtaactactaacgtcgtacggtcgacgtacgaccatacgtcgtacgttacttcgacttcccgtcccgtactacgtagtacgtagtccgtacg

SEQ ID NO: 16774 - DNA, 838 bp, Homo sapiens
  misc_feature: GYAE6OF01BSCZT.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctcgtggtcgacctacggggacacgtgtgatcgaccctagtcctaccagaccctcccgtggctgtcgtctcggtgggcgaggacgggcccacactacactcgaccaagtccacgaccgaggtagtttagttttacgacggtcctacccgaacaaacaacgtaacttacgttacgtcgttaggtataccgaaggacaaacggaaaccaggacctacgtacccttacctaaactcgaccttactaagttaccggtggtacctaccgtaccccggaaccccggtacgtaacccggttccccggggtcctaccggtaccgtacttaccgaggtcgggccggacgggtccggggtacgtacgggaaccttagttacgtttcccaccgttccttaaccgacctaccgtaccgtaccggacctaccggtcccgtacggacgtacggtaccgtaaggtaaggttacggttacggttacggttaactttaaccgtttttaataccgttacggttaaccgtttaacccggttttacgggtttacccggtccgggttaaccggttacccgggaacccgggtaaacgggttaaccggtaaagggttaaccgtaaaggttaaaccgtaacggtacggttacgggtacgtacccgtaccggtacctaccgttacgttcgttaaccgctttacggtacccgttcccgttaccctaccgttacgtaccggaagttaccggtaccgttacg

SEQ ID NO: 16775 - DNA, 595 bp, Homo sapiens
  misc_feature: GYAE6OF01BPFM2.9.12.B01.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacggctccgacaacaagaactacttagcttggtatcagcaagaaaccaggacacgcctacctaactgctcattaactgggcatccgtacccgactaacgtcccgggtcctacggaccgtattcgagtcggcgacggcgggtctgggacaggtactttcgacttctacgacactcacgcacgcctcgcgacggctaggaacgtagtggtggtacttagtttaacttacgttgtacctaacgtttacgtttcgtcgggtacgttccggacgtaaacgggacgtaaacgggtaggtaaactacgaaacggtacgtacggtcggacttcgacctaccgtacgtacttcgttcgttctacccg

SEQ ID NO: 16776 - DNA, 837 bp, Homo sapiens
  misc_feature: GYAE6OF01BANX1.9.12.B01.1.454.CMB.1.raw
  modified_base (542)..(542): a, c, t, g, unknown or other
  misc_feature (542)..(542): n is a, c, g, or t
tcagtgatacgtctcacgaccggtgctcgatttagtagtgtagattccgcgggcagcaagatggtgttgcagacccaggtcttcatttctctgttgctctggatctctggtgcccgtacggggacatcggtgatcgacccagtcctccgacgacctcccgtggcttgtgtcctcgtgggcgaggacggaccaccactacaacgtgacgaacgtccacgcctagtagttagttttacgaccggctaccgaacaaacaacgtaaccttacgttagtcgttaggtactacagacgaaacgtaaccgaagaccacgtaccctaacctaactcgtactacgtaattacgcggtacctacgttacccgacccgtacgtaaccgggtccccggtaccgtacggaaccgtgtaacggcgttacgggacgtaccgggtcgggtacgtaacgggtactaacggttacgtttaccaccgttacctaccaacctacggtacacggtacccgaccgtaccggtacgaccgggtaacgtaccggaagttaaacggngggtttcgggtaacgttacgtttaacgtttaaccggtttacgttaccggtttaacctaaacggtttttcgggttaccggttaccgggtaccgttaccgggaaacgggtacggaaacggtaacgggttaaaccgtaacgtaaaccgtaaacggttagttaccgggtagttacccgaaccggtccgtaaaccttcggttttaccccgtacgttacccgtttaacccgttcccgttacccccgttaaccccgttaccgttagttaacccggtaaccgtttaaacgtcggttaacccgg

SEQ ID NO: 16777 - DNA, 711 bp, Homo sapiens
  misc_feature: GYAE6OF01CK3AJ.9.12.B01.1.454.CMB.1.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (332)..(332): a, c, t, g, unknown or other
  misc_feature (332)..(332): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctcgtggtgcctacggggacatcgtgatgacccagtctccagacctccctggctgtgtctcgtgggcgagagggccaccatcaactgacaagtccagccagtagtnttttagacggctaccgaanaacaagaactactagcttaggtatcagacaagaaaccaggacacggcctaccgtaaactgacctactaagtttaaaccnggggacctaacgttcccgtaaccccggacgtaaaaccgttcccgggggttacccctaggtaacccggtaactttccgaaaggtccggcgtaacggggtccgggtacgttagggactaggttactttcaacgttctaccaccagtacacgacgtacgtcctggaccgaagggcttaacgggaagtacgttagtacggtacttaaggttttaacttacgttacgtaacgtaacgtttaacggtttccgtcgggtacggtttacggaccggtaaacggggtaccaaagggtaggtaaaacgttaacgaaaccggtaaaggttcggtggtaccgttaccgtcctaaacccgtaggttcgttaccgttagtttccctaacccgg

SEQ ID NO: 16778 - DNA, 752 bp, Homo sapiens
  misc_feature: GYAE6OF01E2662.9.12.B01.1.454.CMB.1.raw
  modified_base (194)..(194): a, c, t, g, unknown or other
  misc_feature (194)..(194): n is a, c, g, or t
  modified_base (342)..(342): a, c, t, g, unknown or other
  misc_feature (342)..(342): n is a, c, g, or t
tcagtgatacgtctcacgaccggtgctcgatttagtagtgtagattccgcgggggagcgtacaacaggcaggcagggcagcaagatggtgttgcagaccaggtcttcatttctctgttgctctgatctctggtgcctacgggacatcgtgatgacccagtctccagacctcctggctgtgtctcgtgggcgagngggccaccatcaactgccacgtccagccagagttagtttagccggcttccgaactaacaagaacttacgttagcgttaggtactcgacgcgaaacgaaaccgagaccgacgtaccgttactaaactcgacttacgtaacgtttaccgngggtactacgtccgtacccggactaacgttccccggggtacctcgtaaccgtacgttcgacgcggtaccgtaggcccggggttagtaccggggtaactacggttacttttaccgacctttacctacgaaccctacgtaccgacgtaccgacgtacccgtgacctaagggccttaagggtaacgtacggttaggacgtcgtttaacggtttacttaacggtacgtttaacctaacggtttcggttttaccgggtacccggggttacgttacccgggtaaccggtaacggggtaacctaaacggggtaaaccggtaaaccgttaaacggtaaacccgtaaggttacgggacttacccggtaacacccgttaaccgttacttacgttaccgtttaccgttcccttaaacccgg

SEQ ID NO: 16779 - DNA, 779 bp, Homo sapiens
  misc_feature: GYAE6OF01AKQFU.9.12.B01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagacggccaccatcaactgacaacgtccagccagngtgttttanacggctccgacaacgaagaacttactagcttggtatcagcaagaaaccaggacagccctacctaaacgcgctacaattaactgggctactccgtaccccgacgtaaccggtcccggggtaccctcggtaccgtacttacgacggtaggcgtcggtacgggtcccggtggaccgagttaccttaccgtaccttacctccaccctactaccgtaacggccgtaaccggcccgttacggacccgaacgggttcccgtaagggtaaaaggtggtacggttacggggttaccttaaggttttagtttaccgttaccgttagttaaacccgtttacgttttcccgggtttacgggggttaccgttaccggggaaccgtaaaccggggtaacccggtaaaacgggggttaacgtaaaccggttaaaccgaaacggtaacggttaaccggtcggttacccggttaccgaccgtaacccgtaaccgttcgtttaacgggtttacctcgtttaaccgtcccgtttacccccgtacgttacccgtaataccggttaacgttaaaccgggttaaccc

SEQ ID NO: 16780 - DNA, 654 bp, Homo sapiens
  misc_feature: GYAE6OF01AI7UL.9.12.B01.1.454.CMB.1.raw
  modified_base (238)..(238): a, c, t, g, unknown or other
  misc_feature (238)..(238): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgttttanacgctccgacaacaagaactacttagcttggtatcagacaagaaaccgaggacacgtcctacctaaactgacctactaacttaacgtgggactactacccgtaccccgggctaacggtcccggggtccctacggaccgtatttcgaggtcggacgagggtcggtcgtagggactaggtactttccacttcctacacctactcacgcgacgtcctgaccgaggcaggaagtacgtggtcggtacttagtttacgttacgttacgtaaccttaacgttaccggttttcggtcgggttccggttaccggaccggtaacgggtaaccgtagggtaacggtaaactaaccggtaaacgtaacgttcggtacggtaccgtacgtaccgtaccttagtacccgttcgttaccgttcgtacccg

SEQ ID NO: 16781 - DNA, 717 bp, Homo sapiens
  misc_feature: GYAE6OF01C46ET.9.12.B01.1.454.CMB.1.raw
  modified_base (143)..(143): a, c, t, g, unknown or other
  misc_feature (143)..(143): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (616)..(616): a, c, t, g, unknown or other
  misc_feature (616)..(616): n is a, c, g, or t
  modified_base (629)..(629): a, c, t, g, unknown or other
  misc_feature (629)..(629): n is a, c, g, or t
  modified_base (666)..(666): a, c, t, g, unknown or other
  misc_feature (666)..(666): n is a, c, g, or t
  modified_base (710)..(710): a, c, t, g, unknown or other
  misc_feature (710)..(710): n is a, c, g, or t
tcagtgatacgtctcacgaccggtgctcgatttagtagtgtagattccgcgggcagcaagatggtgttgcagacccaggtcttcgatttctctgttgctcgtggatctcgtggtcgccgtacgggacatcggtagatcgaccngtctccagtctcccgtggcgtgtgtctcgtagggcgaggacggcctaccatacaacctggacaacgccgagacctaagtagttgttttacaccggctaccgaaanaaaccgaagtaacttacgtgtcgttaggtaactcgaagacgaacgaaaccgnggaacaccgtaccttaacctaaagtcactataaacgttaccgcggtacaccgttaccgacccggattaaccggtcccggtaccacggtaaccctagtacggacggacgcgtaacgggtcggttcaagggtaacgtattacgttaccactccgtaacgaactagacgacgacgacttcggagacggaagtcaaggagttagttcggacgttaactaggttaacttaccgaggttaaccttaaggttcgttaccggcggggtctaccggaacggttaccggaagttaacgaacggtaataaaaccggacgtttaaagngggtttaccccgngttaaccacgttacgtacgtccgttattacttacccncccgttaaccgtaccctaaacgtacccgtaaaggaccgttaaancggttac

SEQ ID NO: 16782 - DNA, 812 bp, Homo sapiens
  misc_feature: GYAE6OF01B211O.9.12.B01.1.454.CMB.1.raw
  modified_base (132)..(132): a, c, t, g, unknown or other
  misc_feature (132)..(132): n is a, c, g, or t
  modified_base (139)..(139): a, c, t, g, unknown or other
  misc_feature (139)..(139): n is a, c, g, or t
  modified_base (226)..(226): a, c, t, g, unknown or other
  misc_feature (226)..(226): n is a, c, g, or t
  modified_base (486)..(486): a, c, t, g, unknown or other
  misc_feature (486)..(486): n is a, c, g, or t
  modified_base (657)..(657): a, c, t, g, unknown or other
  misc_feature (657)..(657): n is a, c, g, or t
tcagtgatacgtctcacgaccggtgctcgatttagtagtgtagattccgcgggcagcaagatggtgttgcagacccaggtcttcagtttctctgttgctctggatctctggtgccgtacgggacagtcgtgntcgaccngtctcagtacctccgtggactgtcgtctcgtgggcaggacggccactactcgaatgacgacgtccagcctagtagttacgttttacncggtacctacgaaacaacgaaagtaaccgtttaacttaggttagttaggtaactcgaacgtacgaacgaaaacgacggtacgtaccgtacccttactaaaacgtctaacctacttaacgttaacgtgggtacctacgtacccgtaccccggataaccggttcccggggtcctacgtaccgttagttaccgtaggtcgacggtagggtaccggttacgtagggaacgtacgttacttcgacctctaccagtactacgaacncgacgtccctaggaccgaggacgtaaggtaaacgtggtacggttacgggtaacgtttacgtttaaaccggtttctaaggttaaccgttaacggttttaccggtttaccgggtccgggttaaccgggtaccgggtacgggtaaccggtaaacgttaggggaaccgttaaaanaaccgggttaaacgtaacgtcgggtagtacccggtcgtaccgtacgtttaacctccgggtttaacttacccttaacggggtaccgttttaccccctacccggtacgtttaccgtaaacggtaacggttttaacccggtaaacgtttaaacccggg

SEQ ID NO: 16783 - DNA, 819 bp, Homo sapiens
  misc_feature: GYAE6OF01AQPCZ.9.12.B01.1.454.CMB.1.raw
  modified_base (136)..(136): a, c, t, g, unknown or other
  misc_feature (136)..(136): n is a, c, g, or t
  modified_base (245)..(245): a, c, t, g, unknown or other
  misc_feature (245)..(245): n is a, c, g, or t
  modified_base (321)..(321): a, c, t, g, unknown or other
  misc_feature (321)..(321): n is a, c, g, or t
tcagtgatacgtctcacgaccggtgctcgatttagtagtgtagattcggcggggggggtctcaggaggcagcgctctcaggacgtcaccaccatggcctggctctgctcctcctcaccctctcactcagggcacgngggtcctgggcccagtctgccctgactcagccctccctcgcggtccgggtctcctggacacggtccggtccacctagttccctccgtggacctaccgtacgggaaaccnggtaccaggttgtagttggtttagggggaattttacgtcgtaacccgttttgtccttccgttcggtaacccaaacncgaccgacccgaacggaccaaaacccggacccccctaaaacttccacgttacctaattttacgtacgtaacggtaccaaccggtaacggtcccggcccgttacggttaggggtttccctagttcctcgtttccgtcgtcggaccttaccgtaacgttcgtcgaaaccaccggtccgtacccttcccgtagtaaacctacgttccgtacgttcgggccgtaccgtcggtacgtacggacggtacggtacggtacgtacgtaattacgttacgtcgtcgtcgtctacgtactagtacgtacgaacgtacgtacggtacggtaccgtaccgtacccggttacggtacgggttacgggtaccgggtaaccgggtaccggtaaacggttaccggtacccggttacccggttaacggttaccggtaacccggtacccggaccggtcccggtaaaaaaaaaccccggttcccccgggtacccggttacccgttaacccgtcccgg

SEQ ID NO: 16784 - DNA, 676 bp, Homo sapiens
  misc_feature: GYAE6OF01DPOFR.9.12.B01.1.454.CMB.1.raw
  modified_base (217)..(217): a, c, t, g, unknown or other
  misc_feature (217)..(217): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagtagttgttttanacggctaccgaacaaacaagaacttacttagcttaggtatcagacaaacgaaaccgaggaaccacgaccctacctaaactgctactaattaaacgtgggacctaacgtccgtaaccccggacgtaaccgttcccgggggttaccctcggaacccgtacttcgaggtcggacgaggtccggggtcgtacggggactaggttactttaccacttacctcaaccatacgagccacgccgtgacgacggctagaagtagtggtcgtagttaagtttacttacgtgttaacctaacgtttacggttttcggtaccgggtacggttaccgggaacggtaacgggaaccgtaagggtaaacggtaaacgtaaccgtaaacggtacgtcgggtacgtccgtagaccctacgtacgttcttacgttcttactccgttcctacccgtctactgtaacgagtaacgtacg

SEQ ID NO: 16785 - DNA, 823 bp, Homo sapiens
  misc_feature: GYAE6OF01DJ3VB.9.12.B01.1.454.CMB.1.raw
  modified_base (182)..(182): a, c, t, g, unknown or other
  misc_feature (182)..(182): n is a, c, g, or t
  modified_base (787)..(787): a, c, t, g, unknown or other
  misc_feature (787)..(787): n is a, c, g, or t
tcagtgatacgtctcacgaccggtgctcgatttagtagtgtagattccgcgggcagcaagatggtgttgcagacccaggtcttcatttctctgttgctctggatctcgtggtcgccgtacgggacatcggtgatcgaccctagtcctaccgacgtacctcccgtggcttggtcgtcgtcggngggacgaggaccggccctacatacaacgtcgacgtaacgtccgacgaccgtaaggtacggtttagtttacgaccggacctacgaaacaaaacgaacgtaacttacgttacgtcgttaggtactacgacgaacgaaacgaaaccgacggacctaccgtaccctaacgtaactcgtacctactaacgtacggtcggacctaccgtacccgaccggtacgtaacccggttcccggtacctacggacgtacgtcggacggtagaccggacgggtcggtacgagggtacttacgttaccttaccgacccgttacctaccgaaaccgttcgaacccggtacgacccgttaacggtcccggttaggaaccgtaacgggtacgttaacggaacgtaggtttacgggaacgttttaaccgggtttaatttaaccgttacggtaacctttaacgggttaaacccgttttcggggtccggttaccgggtacggtttaaccggaaaccgggtaacggtaaacgggtaacggtaacgttaaacgaacgtaaacggttcgacgtcgtacgtcgaacctacgtacgtttcacccgtttactacccggttccgttaccccnccgtaggttaaccctagaaccgggtacttaacgtcg

SEQ ID NO: 16786 - DNA, 677 bp, Homo sapiens
  misc_feature: GYAE6OF01BE2KX.9.12.B01.1.454.CMB.1.raw
  modified_base (374)..(374): a, c, t, g, unknown or other
  misc_feature (374)..(374): n is a, c, g, or t
  modified_base (636)..(636): a, c, t, g, unknown or other
  misc_feature (636)..(636): n is a, c, g, or t
tcagtgatacgtctcacgaccggtgctcgatttagtagtgtagattccgcgggcagcaaagatggtgttgcagacccaggtcttcatttctctgttgctctggatctctggtgccgtacggggacatcgtgatcgacccagtctccagacctccctggctgtgtcgtcgtgggcgaggacgggcccaccatcaactgacgaagtccgagccaggtacgttgttttaacgacggctacccgaacaaacgaacgaacttaacttagtcgttaggtatcgagaccgaaacgaaaaccgtaggaccacgaccctaacctaaactgctactaattaacgtggactactccgtaccccggataccggtcccgggttaccncggtaccgtagttcgaacgtgggacctacggcgggtgtacggactagtactttcactctaccacgtatccgacgtcaacgtccgtagaccgtcggagtacgaagtagtcggtagtcgtaagttttacgtacttcgtaactaaccgtttcggttttaccggtccgggttacgttaaccgggccgtaacgggtaaccgtaaggtacgaaacgtagaaaccggacgtggtccgctacggacctacgtacgtccgttactaccttntaccgttcctaccgtctagtacccgtcgaaggtacctaccg

SEQ ID NO: 16787 - DNA, 690 bp, Homo sapiens
  misc_feature: GYAE6OF01BM2C8.9.12.B01.1.454.CMB.1.raw
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
  modified_base (654)..(654): a, c, t, g, unknown or other
  misc_feature (654)..(654): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgaccctagtctccagacctcccgtggctgtgtctcgtggggcgagacgggccacatcaactgacaagtccagccagtagttgtttagccggctaccgaactaacaaagtaacttacttagnttaggtatcgagacgaacgtaaaccgnggaaccacgtacccttacctaaaacgttcgaccttaacaacgttttaacgnggggtacctaacgttaccccgtaaccccgggtacgtaaccgggttcccccgggggttaccctaacggtaaccccggttatttacccgggaaggttcgggaccggtaacgggccggggttacgtacggggactaggttactttccgactccgtaccaactcgtcaacgccgacgtccgtagacgtaggcgtaaggacggtagtaccgggtagtacgtttaaggtttactacggttacgtacgtagtttacggtttccgacgggtcggtaccgacggtaacgaacgtaggtaagactacgaaaccntgggactcncgacacgtctntcgtcttctacctccgctacctatagcgtagcgtac

SEQ ID NO: 16788 - DNA, 901 bp, Homo sapiens
  misc_feature: GYAE6OF01ELSPV.9.12.B01.1.454.CMB.1.raw
tcagtgatacgtctcacgaccggtgctcgatttagtagtgtagattccgcgggcagcaagatggtgttgcagacccaggtcttctatttctctgttgctcgtggattctcgtggtcgccggtacggggacatcggtagatcgaccctagtcctaccgaacgtcccttcccgtggtcgttgttcgtctcggtgggacgacgggacggacccaactatacaacgtgtaacgaacgtccgacgaccgtaaggttaagttttacgttttacgaccggtcctaccgaaacgaaactaaacgtaacttacgttacgtcggttagtactacgaagaaccgaaacgaaccgagacctaccgtacctaactaactcgtacttaacgtaacgttaccggtcggaccgttaacccgtacccggtaacccgacggttacccgggtacccgggtcccgtaacggtaccgttacgtcggtacgggtacgggacgggacgggttccgggtacggtaacgggtacttaacgttccttaccgttacctaccgtaccctaacgtacaacgcggtacctcgtacgtaccggaggtacggtacgtaaggtaacgtttggttacgggtaagttcgtttaaacgttttaccgttacgtttaccttaacggtttacggttttccgggtttaccggggttaccgggttacccgggtttaccggaaacgggttaaccgggtaacggttaaacggtaaacggttaaccgtaaacggtacggtaacggttggaacccgttacggtacccgtacccgtaacttccggtttacccgttaccgttttacccgtcccgttaccccgtttaccccgtacccgttaacggttaaccgttaaaccggtaaccggttacggttaaccggttaccgg

SEQ ID NO: 16789 - DNA, 643 bp, Homo sapiens
  misc_feature: GYAE6OF01BBO96.9.12.B01.1.454.CMB.1.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (507)..(507): a, c, t, g, unknown or other
  misc_feature (507)..(507): n is a, c, g, or t
tcagtgatacgtctcacgaccggtgctcgatttagtagtgtagattcggcggggggggtctcaggaggcagcgctctcaggacgtcaccaccatggcctggctctgctcctcctcaccctctcactcagggcacgagggtcctgggcccaggtctcggaccctgactcagtcccttcccgtccggcgtccgggtctcccgtaggactagtcggtccacctatcctcctgccacgtcgaaccngtcagtnactagttggntactttaanaactgtgtcctcgtacggtaccaanacgccaacccgtaggacctaaacgtacccaaattcgaattgtatttacgnggagtacaaatacgccgtacctggtcgggtaccttgactccgtacttcgcgtcgactaccgtagtcgtacgacctaacgccggtcctcgtcgtccctnttcggcggtccncgagctacggancgtacggntcgtagtactttaacgtgtcgacctcgtacttanaacgttagtccgacggtaccacctaaccgtagttacgttacgtacccgtagggtacgtccgggtaacctaccggcccgtacgtggtaccgtcaccggtacccgaacccgtaccctaactcgtctaccgcttacccg

SEQ ID NO: 16790 - DNA, 706 bp, Homo sapiens
  misc_feature: GYAE6OF01DWMR8.9.12.B01.1.454.CMB.1.raw
  modified_base (223)..(223): a, c, t, g, unknown or other
  misc_feature (223)..(223): n is a, c, g, or t
  modified_base (323)..(323): a, c, t, g, unknown or other
  misc_feature (323)..(323): n is a, c, g, or t
  modified_base (460)..(460): a, c, t, g, unknown or other
  misc_feature (460)..(460): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtcctccagacctccctggctgtgtctcgtgggacgaggacgggccacctatcaactgacaagtccagccagtagttgttttanaccggcctaccgaacaaacaacgtaactacgttagcgttggtatcagacaagaaaaccgaggaccacgtccctacctaaactcgctactaactttaacgngggaccacttcccgtacccggtacgtaaccggttcccggggtccctacggaaccgtattcgaggtcggcgacgggtcgggtcgtagggactaggtactttccacttcctccaaccagtccgaaggtacgacgtcccngccgaaggcgtagaaggtatgggtgtacctttaagtttactttacgtacgttacgaaccgtttcggttttccggtaccggggtacgttcccgggaacggtaaaccgggaccgtaaagggttaacgtaaaacgtaaccgtaagggtaactcgggtacgtccgacgacctaccgacgttccgtacgttccttcccgttacgttcccctacccggtaccctaagttacctaaacggacgttacgtaacg

SEQ ID NO: 16791 - DNA, 865 bp, Homo sapiens
  misc_feature: GYAE6OF01DIKW3.9.12.B01.1.454.CMB.1.raw
tcagtgatacgtctcacgaccggtgctcgatttagtagtgtagattccgcgggcgagcaagatggtgttgcagacccaggtcttcatttctctgttgctctggatctctggtgcctacggggacatcgtgatcgacccagtctcagacctccctggctgtgtctcgtgggcgagagggccaaccatcaactgacaagtccagccagagttgttttatacggctaccgacaaacagaactactagctgtatcagcaagaaccaggacacgcctaccgtaaactcgctacattaacgtgggactactccgtaccggcgtaaacgtcccgggggtccctacggtaccgtattacgaggttcgggacctacgggtaccggggttcgtacgggggaactaaggttaaccttttccgaaccttaccgtacctaaccccaacttacgaaccggaccgtaacggtcccgttacgggaccggtaacgggtacccgttaagggtaaagggtaccggtttagggttacgggttaacccggtttaaaggtttttaaccttttaaccggttaacggtttaacccgttaaacggttttacccgggtttttttaccgggttacccgggggtttaacccgggtttcccggggtaaacccgggtaaaaccgggggttaaccccggttaaaagggggttaacccgggtaaaacgttaaaacccgggtaaaaccggttaaacggttacggggttaccggtaccgttacgggaacccgttaacccgtacgtttacccggttacgggtttaccttacggttacccccttccggtttaccccggtaacccttagtaccttaaccgggaaacgttaccggttaaaccc

SEQ ID NO: 16792 - DNA, 881 bp, Homo sapiens
  misc_feature: GYAE6OF01DEL6B.9.12.B01.1.454.CMB.1.raw
  modified_base (178)..(178): a, c, t, g, unknown or other
  misc_feature (178)..(178): n is a, c, g, or t
tcagtgatacgtctcacgaccggtgctcgatttagtagtgtagattccgcgggcagcaagatggtgttgcagacccaggtcttcatttctctgttgctctggatctctggtcgccgtaacgggggacatcgtgatacgaccccagtcctccacgacctcccgtggctggtcgtctcgnggggcgagacgggccaccatcaactcgacaacgtccacgccgagtagttcgttttacgtaccggtcctaccgaacaaacgaaagtaaaccttacgttacgcgtttaggtactacacggaccaaacggaaaacccagggtaaccaacgaccctaacctaaaactgtacctactaacgttaacgtgggacctactacccgtaccccggactaaccggttccccggggtcctacggaaccgtacttgaacgtcgggaccgagggtccgggtcggtacgggactaacgttactttcccacttccgtaccgaaccctattaccgaacgtccgtaacgtcccgttacggccgtacgggtaccgtaagtaaaggtcggttcggttacgggttacctttaaaaggttttaccgttacttaaccggttacccgttaaacggtttacggtttttcccgggtaccgggggttacccggtttaccggggtaaccccggtaaaacggggtaaccgggttaaacgggtaaacgggttaaaccgtaaaccgggtaaaaccgttaacgggttacgggtacggggtaacccttaccgaacccggttaaccctacggtttacggtttaccccgttacgtttcccgttacccgttttacccccgtaaccccgtaccttaacgggttaacctaacgggtaaaccgttaacccgttaaacccgg

SEQ ID NO: 16793 - DNA, 921 bp, Homo sapiens
  misc_feature: GYAE6OF01A1WSB.9.12.B01.1.454.CMB.1.raw
  modified_base (265)..(265): a, c, t, g, unknown or other
  misc_feature (265)..(265): n is a, c, g, or t
tcagtgatacgtctcacgaccggtgctcgatttagtagtgtagattcggcgggggggggtctcaggaggcagcgctctcaggacgtcaccaccatggcctgggctctgctcctcctcaccctcctcactcgagggcacgacgggtcctggggccctagtcctcgacccctgacctcaccgtccctcccgtccggtccggttcccgggtcctccgtaggacctacggtccggtaccaacctctcctccgtcgactacgtacgaacncgacgtagtcgactaggttcgtacttacttaatactagttcgtaccgttaccgtaccggtaaccaacgtaccgacccgaaaccggtacgtaaccgtaaaacccctaacccgtaaactcgtaagttaagtttaacgtttagtacggtaaccggtaagaaacggtcccggtcccggttacccgttcgggggttacccggtaccctagttaccgttccgttcccgttccgaacggttaccgtacctaaccggttaccggttcggaacccgggtaacctaaacccggtccccgttaccccgtacccggtaacgggttacccttcggtacggttcccggggacctcccggggtagaccggttaggaaccttacgggtaacggtaccgtttaacgtaactttaacgtttaacgtaccggtccgtaaccgtaccgtacgtaacggttcctacgggaccgtaccggtaccctaacgttaaacccttagttaacgttccgggtaaccgggtaacggaccgggtaccccggtaaaccggttacccggttaaccccggttactccccggggttaaccaccccggggtaaaaccccggtccccggtaaaccccggtaaccccttaaccggttccggttaccttaaccccgttcccggttaacccccgg

SEQ ID NO: 16794 - DNA, 700 bp, Homo sapiens
  misc_feature: GYAE6OF01AGE3I.9.12.B01.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatcgacccagtctccagacctcccgtggctgtcgtctcgtgggcgaggacggccaccancaactcgacaacgtccacgcagtagttgttttanaccggctaccgaacaacgaaagaaccttacgttagcgttaggtatacagacgaacgaaaaccgaggaccaccgtacccttaaccgaaactcgacttactaacgttaacgcgggactacgtaccgtacccggctaaccggtcccgggtaccctaggaccgtattcgacggtcgacgtacgggtcggtacgtacgggactacgttactttccgaccttccacaaccacgtacgacgaccgtacgccgtcgacggagtcgtaagaacgtagtggtacgtagtttatttaacgtacgttacgttaacctacggtttcgtttccggaccgggttacggttacccggaaccggaaccgggtaacggtaacgggtaaacgtaaaccgtaaacggaaccgtaaggtccggtgtacttaccggaacttacccacgtttaccgttcgttccgtacttacccccg

SEQ ID NO: 16795 - DNA, 673 bp, Homo sapiens
  misc_feature: GYAE6OF01EWCTR.9.12.B01.1.454.CMB.1.raw
  modified_base (620)..(620): a, c, t, g, unknown or other
  misc_feature (620)..(620): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctggggcgagagggccaccatcaactgcaagtccagccagagttgttttatacggctccgaacaacaagaactacttagtcttggtatcagacaacgaaaccaggacacgacctacctaaaactgcctactaatttaacgtggggacactaccgtaaccccgggactaaacggttcccgggggtaccctcggaaccgtattcgaggtcggcgacggccggggtacgtaggggactaggtaactttcacctactccaactactcgacgcacgcccgtgccgaggtcagggtaacgtagtggtaggtcttaagttttagtacgttgtaacccttaaggtttacgttttccggtcggggttccgtttaccgggaacggtaaacggggtaacgtaacgggtaaggtaaactaaacggtaaacgacggttaggtcgggactacggacctacgtacgttccgtnttccttctacgttcccttacccgaccttcgttacacggtaagtccgttaaccg

SEQ ID NO: 16796 - DNA, 825 bp, Homo sapiens
  misc_feature: GYAE6OF01BKLVJ.9.12.B01.1.454.CMB.1.raw
  modified_base (329)..(329): a, c, t, g, unknown or other
  misc_feature (329)..(329): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagacctcccgtggctgtgtctcgtgggcgaggacgggccaccatacaactgacaagtccacgccagagttagtttacacggctaccgaacaaacaaagaacttacttagtcgttaggtactacgagacaacgaaaccgtaggaccacgtacctaacctaaacgtcgacttaacgaatttaacgnggcctacttacccggacccgagtaaccgtcccggggtcccaggtaaccgtatccgtaaggtcggacgacgggtccggggtacgtacgggaactaaagttacgtttacccaaccgttacctaccctaaaccctataccggaacgccgtaacgtccccgtaaggacccgtaagggtacgtaaggtaaacggtagttcgggttaacggtaacgtttaacgttttaacttaacgtacgttaaaccgttaacgttttaccggttttaccggcggggttacccgtttaaccgggaaccgggaaaccgggttaacggtaaacgggtaacggtaaaacctttaaacccggaaaaccggttaaccggtttacggtaccggtacggtaaccggtacccgttaaccgttaaacgtttcgttacttacccgttccggttaaaccttccccggttaccccggtaaccttacggttacccgttaaacgggaacgttaacggtttaaccgg

SEQ ID NO: 16797 - DNA, 933 bp, Homo sapiens
  misc_feature: GYAE6OF01DNM8C.9.12.B01.1.454.CMB.1.raw
tcagtgatacgtctcacgaccggtgctcgatttagtagtgtagattcggcgggggggggtctcaggaggcagcgctctcaggacgtcaccaccatggccgtggctctgctcctcctccaccctctcactcagggcacgagggtcctgggcccagtctcgccctgactcacgccctcccgtccggccggtccgggtctccgtaggacctaggtccggtaccacgtacttcctacctgacctacgacggaaccaggtacctaggtacgtacgttagttcgggtacttaacttaaacttactagttcgttaccgtacccgtaacggtaaccaacgaccgtacccgtaaccggaacggtaaaccctaaacccgttaacccctaaaacgtctaagtttacggtaacttttacggtacgggtaacggtaacaaacgggttaccggtcccggttcccggttcggggttacccgggtcctaggtaccgttccgttcttccgtaccggtccgtaccttaccgtaacggttcgacccggtaacctaaccggtcccggtcccgttacccgaccggttacccgttcgtaccgggtcccgtccgtacccggtaacggtaccgttaacggacggttaaccgggtaaggttcccggtaacgttttaacgggtttaaacctttacgtttaaccgtacggttaacccgtaccgtttaacctagttaaccgttacggaaccggtaacccgtaaacccggtacccctaaacgttaacgtttaccggttacgggttaaaccgggtaccggggttacccggtaaccgtaccccgggggtacccttaccgggtaaccccgggttcgaaacccgggtaccccaacccgggtaacccgaaaccccgtaccccgtttaacccacggttaaccctccccgtttaacccggttccccccg

SEQ ID NO: 16798 - DNA, 691 bp, Homo sapiens
  misc_feature: GYAE6OF01C67NV.9.12.B01.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (356)..(356): a, c, t, g, unknown or other
  misc_feature (356)..(356): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcgaggcacgagggtcctgggcccagtctgccctgactcacgccctccctccgcgtccggtctccgtggacnggtcgtcaccatctccngccacgtggaaccagcagtgactgttggtntacttaagtaactntcgtctacgtagtaaccaagcgacaccgaacggaccaaaccgtcccaaatcatagtattagtagagtacgaatacgccgtccgtcgtcggtacccngtactccgtcttcgtcgtcggcctcgagtcgtacggacaaccgccgtccctccgtacgtacccgttcgtaccggttcggccgtacgtcggaccgttaggaacgtacgtacggaccgttagtaacgttaattttaacgtaccgtacggacacgtttaccagtagttaacgccgtaaccgaccgtaccctaacgtaacgttaaggtttccgtaacggttacgggaaaccggttcggaaaccccgtaggtacccgttaccgtacccggttacggccgaacccgtaaccccggaacgaccccctaaacccggtcttccgtaaccgtcccgttaacccgg

SEQ ID NO: 16799 - DNA, 767 bp, Homo sapiens
  misc_feature: GYAE6OF01D8XPV.9.12.B01.1.454.CMB.1.raw
  modified_base (249)..(249): a, c, t, g, unknown or other
  misc_feature (249)..(249): n is a, c, g, or t
  modified_base (337)..(337): a, c, t, g, unknown or other
  misc_feature (337)..(337): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccgagtcctccgagaccttccctggcttgtgtcgtcgtgggacgaggacggaccacctatacaacgtgacaacgtccaggccaggttattgttttacgccggtcctaccgaanaaacaagtaactacgttagcgttagatcgaagacctaacgaaaccgaggacacgtaccctacctaaactcgactactaagttaaccgnggacctactaccgtaccggactacggtcccgggtcctacgacggtattccggagtcggacgagggtccggtgtacggggactacttacgttaccacgttcctaacgacctaagtccgaacgctacggtccgtagaccggtaggtacgtaagtagtaggttcgtagggtaacctttagtttaaccgttacgtaccttacgtttaaccgttacggtttttaccgtacggggtaccgttacccgggtaaccgtaaacggggtaaccgtaaacgggtaacgtaaacgtaaacccggtaaacggtaacgttcggaacggttcccgtagtacccggtacccttaaggttccgttacgtttaccggttaccttaaccggtccccggtttaacctacccggttaaacgtacttaaaccggtaccgttacgtaaccggg

SEQ ID NO: 16800 - DNA, 911 bp, Homo sapiens
  misc_feature: GYAE6OF01DBHNV.9.12.B01.1.454.CMB.1.raw
  modified_base (222)..(222): a, c, t, g, unknown or other
  misc_feature (222)..(222): n is a, c, g, or t
tcagtgatacgtctcacgaccggtgctcgatttagtagtgtagattccgcgggcagcaagatggtgttgcagacccaggtcttacaagtttctctgttgctctggatctctggtgccgtacggggacatcgtgatcggacccagtcctacgagacctcccgtggctgtcgtctcgtgggcgaggacgggccaaccatcaactgacaagtccagccagagttnttttagacggtctaccgaacaacgaagtaactacgttagcttaggtatcgagcaacgaaaccgagtacacgtaccctacctaaacgtcgctactaactttaacggtcgggacctacgtacccgtaccccgggaccgtaacccgggttcccgggggttacccctacggtaacccgttacgtttaccggaacgggttcgggacccgtacggggtccggggttacggttacgggggaacctaaacggtttacctttacccgtacccgttaccttaacccgtaacccggacgttaccggaaggtacccgtaaccggtcccgtaggaaccggtaacgggtaccgttaaagggtaacggtacgggttacgggtttaccggggtaacttttaaacgggtttttaacctttaaccggtttaccggttaaaccgtttaaacccggtttttcggtttttaccccgggggtacccgggtttacccggggttaaccggggttaacccggaaaaacccgggggttaaccggtaaaaccggggttaagggtaaaaacccggttaaccgtaaaccggttaacgttcgggtaaccggttccggtacgacccgttacgtaccgtttcgttaccgtttaccggttccctaaccgttcccgttaaccccgtcttaacgtaccggttaacgaaaccggttagtaacccg

SEQ ID NO: 16801 - DNA, 695 bp, Homo sapiens
  misc_feature: GYAE6OF01B6QX4.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtcgccgtacggggacagtcgtgatcgacccagtcctccagacctcccgtggctgtcgtctcgtgggcgaggacggcccacatcaacgtgactaacgtccacgccaagtagtttgttttaacgaccggcctaccgaaacaaacgaacgtaaaccttacgttacgtcgtttaggtactacgacgaccgaaacgaaaaccgacggaacctaccggtacccttaacctaaaccgtcgtaccttactaacgttaacggtcggactacgtacccgtaacccggacgtaaccggtccccggggtaccctacggtaccgtattacgaggtcgaccgtacgggtcgggtcgtagggactagttacgttcaccgttccaccacgtatccgactcgacgtcctacgcgacgtacgtagaacgttgtgtacggtactttaagtttacgtactagtactaacgtttcgttcggtcggtcgtaccgacggaacggaacgtaggtacgtaactacgaacgtgtacggcgactcgacctactcgtcgttctaccgttctcccgttaccctcccgtactacgtacaacggtacgtacgtacg

SEQ ID NO: 16802 - DNA, 841 bp, Homo sapiens
  misc_feature: GYAE6OF01DIL14.9.12.B01.1.454.CMB.1.raw
  modified_base (415)..(415): a, c, t, g, unknown or other
  misc_feature (415)..(415): n is a, c, g, or t
  modified_base (602)..(602): a, c, t, g, unknown or other
  misc_feature (602)..(602): n is a, c, g, or t
  modified_base (791)..(791): a, c, t, g, unknown or other
  misc_feature (791)..(791): n is a, c, g, or t
tcagtgatacgtctcacgaccggtgctcgatttagtagtgtagattccggcgggcagcaagatggtgttgcagacccaggtcttcatttctctgttgctctggattctcgtggtgccgtacggggacacttcggtagtatccggaacccctagtcctccgaacgtaccttcccgtgggcttggttcgtcgtcggtgggcggaggacggcccaccataccaacgtcgaccaaacgcccgacggaccgaaggtttagtttacggtttttaaacggcccggtacctaacccggaaaacaaaacggtaaaacgttaaacctttaccggtttaacggttcggtttaaggttaactaccgacggaaaccgaaacggaaaacccgtaagggacctaaccgtacccttaaccttaaaccggtntacccttactaacgttaacggtcggtaccaccgttacccggaacccggtacctacccggggtaccccggggtctaaccgtaacggtctttacggacgggccgggacggtcgggttccggggtacggtacgacgttacgttactttaccgacctttaccgacctaccgtacacgactccgtccgacgngtccggagtacgacgtaaggttacgtcgggttattaacgttttaacgtttacttacgtcgttaacctttaacggttcggtttaacccggtcgggtacggtacggaaccggtacgggtaaaccgagggaaacgttaaccaacggtaacgtacggtcgtacggtacggtcctaccgaccttactacggttntaccgttcccgtaccttccgttacctctacttacgacaacggttactacg

SEQ ID NO: 16803 - DNA, 727 bp, Homo sapiens
  misc_feature: GYAE6OF01C0Y90.9.12.B01.1.454.CMB.1.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
  modified_base (512)..(512): a, c, t, g, unknown or other
  misc_feature (512)..(512): n is a, c, g, or t
  modified_base (646)..(646): a, c, t, g, unknown or other
  misc_feature (646)..(646): n is a, c, g, or t
  modified_base (662)..(662): a, c, t, g, unknown or other
  misc_feature (662)..(662): n is a, c, g, or t
tcagtgatacgtctcacgaccggtgctcgatttagtagtgtagattccgcgggcagcaagatggtgttgcagacccaggtcttcatttctctgttgctctggatctcgtggtcgccgtacgggactatcgtgatcgacctacgtcctaccgagtacctcccgtggtctgtcgtcgtcgtcgggagacgacgggaccaacctactacgactagacaacgccgacgccgaagttagttacgtttaacgaccggtacctaccgaaacgaaaacgtaacgtaacctttaccgttaagtcgtttacggtanaacgtaacgactaaaacggaaaccgaacggaacacgttaaccctaactaaacgtntacccgtaataacgttaaccgtcggaactaacctaccgtaacccggacgttaaccggtacccggtaccacgtaaccgtatacgtacggcgtaccgacgggttaccggagtaacgggacttaacgtacttacgacctaccgtacacgtaacncgtacgacttacgcgtacgcgaaggtctaaggacgtaagtgtacggtaacctttaagtttacgtaccgtagtaacccggttatttacggttcggacgtaccgggtagtaacgaagggtacggtaagaaacgtanaacgtaacgtgcgtancttaaccgcaactgtacgtactcgttccaccttccgacgtactagttacaacggtaagcctaagg

SEQ ID NO: 16804 - DNA, 869 bp, Homo sapiens
  misc_feature: GYAE6OF01DC5DM.9.12.B01.1.454.CMB.1.raw
  modified_base (568)..(568): a, c, t, g, unknown or other
  misc_feature (568)..(568): n is a, c, g, or t
tcagtgatacgtctcacgaccggtgctcgatttagtagtgtagattccgcgggcagcaagatggtgttgcagacccaggtcttcatttctctgttgctctggatctctggtcgccgtacgggacatcgtgatacgacccagtcctccagacctcccgtggccttgtcgtctcgtgggacgaggacggccaacctataccaacgtcgacgaacgtccgaacgacctaggttagtttacgttttaacgaccggtccgtaccgaacaaaacgaacgtaacttaccgtttaagtcgttaggtactacgaagaccgaaaacgaaaccgaggaaccaccgttaccctaacctaaacgtcgtacctaacgtaacgttaccggaggtacctaccttaccccggtaaccggaccgtaacccggtttccccggggtaccctacggtaacctttactacggtaaggtcggaccgtacgggtccgggtaccgtaagggaactacggttactttaccgacctttaccaccgtaaactacgtccgaacggaccgtaccgtcccggtaaggccgtaaccgggngtaacggtaaggtcggttacggttacggttaaccgtttaaagttttaccttaacggtcgttaaaccgttacggttttaccggttttaccggggttccgggtaccggtttaaccgggaaccgggttaaacggtaacgggtaaacggtaacgtaaacccgtaaaccggtaaacgttacgggttaccgtcgggtaaccacccgggtaacctacgttaccgtaccgttccgtttacgttaccttacccccgtttacctaccccggttaacctacggttaacgtaaacgtaccggttacgtaccgg

SEQ ID NO: 16805 - DNA, 862 bp, Homo sapiens
  misc_feature: GYAE6OF01EIREM.9.12.B01.1.454.CMB.1.raw
  modified_base (366)..(366): a, c, t, g, unknown or other
  misc_feature (366)..(366): n is a, c, g, or t
tcagtgatacgtctcacgaccggtgctcgatttagtagtgtagattccgcgggcagcaagatggtgttgcagacccaggtcttcatttctctgttgctctggatctctggtcgccgtacgggacatcgtgatcgaccctagtcctcagacctcccgtggtctgtgtctcgtgggcgaggacggccactatacaactgactaacgtccacgccagtagttgtttacgacgctaccgaacaaactaacgtaaccttacgttacgtacgtttaggtaactcgaacgacgaaaaccggtaaaaccgacggaaccgaaccgtaccccttaaaccttaaaccgtcggtaacctaactaaacgttttacgggnggtacctaccgttacccggtaacccggccggttaaaccggtccccggggttacctacgtacctagtaccgaggtcggacgtcgggtacggtcgacggtaacgacgttacttacgtactacctaccgtacgtaactcgtaccggacgtcctacggtcggacgtaacggtacctaaggtaaacgttcgttgggtaccggttaacttttaagtttacgttaccgtagttaacccgttaagttttaccgggtttccggaccggggttacccggttaaccggaaccggttaaacggggtaaaccgttaacggggtaacggttaaaaacccttaccgggtaaaaccggttcggttacggggtaaccggtcccgttaaccgaaaaccggttaccctttagggttaaaccccttttgtttaacccccttcgttaccccggttacccccgttaccccggtattaaaccgggtacgttaagggtaaacccgtttaaccgtacccgg

SEQ ID NO: 16806 - DNA, 679 bp, Homo sapiens
  misc_feature: GYAE6OF01E24FF.9.12.B01.1.454.CMB.1.raw
  modified_base (316)..(316): a, c, t, g, unknown or other
  misc_feature (316)..(316): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccgagccagtagttgttttacgacggtctaccgacaacgaagaaccttacttagccttggtatcagcaacgaaccagacacgccctacctaaacncgctctaacttaacgtcggctactccgtaaccccggactaaccgtcccgggtccctaggaccgtattcgacgtggccgagggtcggtcgtaggactagtactttccgaactcctaccaaccgtactacgacgtaccgacgtccgtacggacgtacggctaaggagtacgtcggtcggtacttagtttactacgtcgttaacaaccgtttggttttcccgtcggggtaccgtttaccgggaccggtaaacggggtaccgtaaacgggttaaaggaaaccgtaacccgtaaacggtaaccgttcggtacggtaccgtacgaacccgtaccgtaacgtttccgttaccgtttcctaccgttacccg

SEQ ID NO: 16807 - DNA, 768 bp, Homo sapiens
  misc_feature: GYAE6OF01EBOXO.9.12.B01.1.454.CMB.1.raw
  modified_base (172)..(172): a, c, t, g, unknown or other
  misc_feature (172)..(172): n is a, c, g, or t
tcagtgatacgtctcacgaccggtgctcgatttagtagtgtagattccgcgggcagcaagatggtgttgcagacccaggtcttcatttctctgttgctctggatctcgtggtcgccgtacgggacatcgtgatcgaccagtcctccacgacctccgtggctgtgtctgtggngaggacggccacatacaacgtcgacacgtccagccgagtagtttagtttaacgaccggtcctaaccgtaaacaaacgtaaacgtaacttacgttagtcgtttaggtactacgagaaccgaaacggaaaccgaacggaccaaccgtacccttaacctaaacgtcgtactaacgttaacgttaacggtcggtactaccgtacccggtaacccggacgtaacccgggttcccggttaccctacggtaccgtacgttacggtacggtcggaccgtacgggtccggttacggtacggtaacgtcttaccgttacgacccttcctaacgaaccctagttacgacggtaccgtaccgtccgtacggacgtacggtagaaacggttagtcggttcggtacgttagtttaacgttttatccgttaacgtacgttaacgttttccggtacccggttacgggtacccgtacgggaaaccggtaacgggtaacggtaaggtaacgaaaacgttacgaaacggttcggtacgtcggtacctcgactctacgtgttacttcctacgtacccgttaccgaccgtacgttactacgaaggtcctgttaccgg

SEQ ID NO: 16808 - DNA, 796 bp, Homo sapiens
  misc_feature: GYAE6OF01CIP75.9.12.B01.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctctcactcagggcacgagggtcctgggcccagtctcgccctgactcgacgcctccctccgcgtccggtctaccgtggacagtcggtcaccancgtacngactacgtacggaaccagactaggtnacagttggtntacttaataacttagtcgtcttaccgtacggtaaccaacgagaccaacccgaaggacaaaccgtacccctaaataccgtaattgtaagtttagtaggaacgtacaaagtaacggccgtacccgtcgtaccggggtcctaggtactccgtctttcgcgtcggtacctacccgtagtacgtacgtaaccgaaccgtacccggtacccttacccggtaacggtacccgttccgtcggtaaccgggtccgtaaccgtagggtaccgtacgaaccgggttagtacggtaggtacttaggttaacttttacgtaacgtgtacaccggttctacgtaacttacggaccggaccgaaccggaaccctaaacccgtaacgttaacgttccggtttaacgggttaacgggtaaccgggtaaccggggtaaacccgtaaccggttaccccgtaaacccggttaacggttaccggtaacccgaaaccggttaccccggaaacccggtaacccccaaacccgttaccgtacgtttaacccacggttttaccccgg

SEQ ID NO: 16809 - DNA, 969 bp, Homo sapiens
  misc_feature: GYAE6OF01EF4SB.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtcctcagactccctggctgtgtctcgtgggcgaggacgggcccaaccataccaacgtcgacgtaaacgtccacgccgagtagtttagttttaacgtaccggctacccgaacaaacaaagtaaccttacgttagcgtttaggtatacgaacgacgaacgaaaccgaggaccacgtccctaacctaaactcgactactaagttacgtgggacctacgttacccgtacccggtactaaccggtcccggggtaccctacggaaccgttacgttaccggaggtacgggacgtacgggtccggggttacggtacggggaaccgttagttaccgtttacgaccttccctaaccgaccctacggtacgacgaccgtacggtaccgtaggaccgtacggtaccgtaagggaacggttacgttacggggttaacggttaccgttttaaggtttttaacgttaaccgtttacccggtttaaaccgttaacccgggttttacggttttttacccggggttacccggggtttaccccggggttaaccgggttaaaccccgggtaaaaccgggggttaaacccgggttaaaacggggttaaaccgggttaaaaacccggtttaaacccggttaaaaacccggttaaccgggtttaaccggggtttaccggtacccggtttaacccggaccgttaaaaccccgttacgggttttaccccgtttacggttttaccccgttaaacccgttttaccccgggttcccccgtttttaaacccccgtacgtttaacccgtttaaccgggttaaacccgggttaaaccggtttaaccccgtttaaaaccgg

SEQ ID NO: 16810 - DNA, 694 bp, Homo sapiens
  misc_feature: GYAE6OF01B1I1S.9.12.B01.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (402)..(402): a, c, t, g, unknown or other
  misc_feature (402)..(402): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
tcagtgatacgtctcacgaccggtgctcgatttagtagtgtagattcggcggggggggtctcaggaggcagcgctctcaggacgtcaccacatggcctggctctgctcctcctcaccctcctcactcgagggcacgacgggtccgtcgggcccagtctcgccctgactcacgcctcctcgcgtccggtctccgnggacagtcgtcacntctctncacgtgaaccagctaggtgactagtttcggatacttaatactagtcgttcctccgacggttaaccaacgtacgaccgaaccgaaggacctaaaaccgtacccctaaactactacgttagttaatttacggacggtaacggttaacaaacggttaccggccggttacccgttcgggtccggggttaccngtacgttccttacttccgtacggtcgtaccttaccgaacgttccgacgggtaaccaccggtacccgtcccttccgtacggtcccgttcgtccgggtacgtccgtaccggtacggtctacggacgttacgacggtacgtacttaggtactttattcgngtacncgttactactagtcgcgtaacgcctaccactagttacgtcgtacgtacggtacggccgtaccggtcgtccgtcgtagtaccgtcaacccgtaccgacccgaaccctactacgtctcccgtactttcccgg

SEQ ID NO: 16811 - DNA, 697 bp, Homo sapiens
  misc_feature: GYAE6OF01AZORQ.9.12.B01.1.454.CMB.1.raw
  modified_base (677)..(677): a, c, t, g, unknown or other
  misc_feature (677)..(677): n is a, c, g, or t
  modified_base (687)..(687): a, c, t, g, unknown or other
  misc_feature (687)..(687): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctgatcggccgtacggggacatcgtgatcgacccgtagtcctccgacgaccgtcccgtggctgtcgtccgtcgtgggcgacggacggaccacatacaacgtgacacgtccacgaccgagtagttacgtttacgacggtcctaccgaacaaacgaacgtaacctacgtacgtcgttacggtactacgaacgtacgaacgtaaaccgaacggtaccaccggtacccttaccgtaaacgtcgtaccgtacgtaacgttacggtcgacgtacgtacccgaccggtacgtaacccggttccggggtaccctacggaccgttagtacggacggtcggacggtacggtccggggttaccggtacgggaacttacggttaccttccgtaaccgtccgtacccaacctcgtaacgaccgtcgtaaccgcccgttagaaccggtacggacgtaagtacgtaggtcggtagttaccttaagtttctacgtacgtactacggtttgtaccgtcggtcgacgacgtacgagtaggagtaactaacgagtaaggcgacgtnacgtcacgtntctgtcgtcc

SEQ ID NO: 16812 - DNA, 914 bp, Homo sapiens
  misc_feature: GYAE6OF01B961P.9.12.B01.1.454.CMB.1.raw
  modified_base (186)..(186): a, c, t, g, unknown or other
  misc_feature (186)..(186): n is a, c, g, or t
  modified_base (411)..(411): a, c, t, g, unknown or other
  misc_feature (411)..(411): n is a, c, g, or t
tcagtgatacgtctcacgaccggtgctcgatttagtagtgtagattccgcgggcagcaagatggtgttgcagacccaggttcttcatttctctgttgctctggactctctggtcgccgtacgggactatcgtagatacgaccagtctccgaacgtcctcccgtggcttcggtcgttaccgttcggngggaccggtagggaccggtaccaacctactaccaaacgtcgacgtaaccgtaccgacgtaccgtaagggtagtttttacggtttaaacggacccgtacccgtaaccggaaaacctaaaacgtaaacgttaaaccgtttacgttacggtacgtttaacggtactacggaacgaaccggaaaacgaaaccggtacgaacctacccgttaacccgttaactaaacgtntacccttaaactaacggttaacgggtcgaacccttaccggtaccccgtaacccggaccgtaaacccggggttccccggtacctaacgggacctttacgtccgggtaacgggtccggaccggtaaggggttacccgggtggtaaacggggaaaccctttagtaacccttccgaacccttacggtaaccctaaaccgggttcaacgaacgttaacccgccgtacggtaccgaacgggttacggaagttaacgtaaaggttccgtaagggtttcctaaggttttaacttaacgtcgttacgtaacgtttacggtttcggttcccgggttaccggccggttaacccgggaaggttaaacccggggaaggtaacggttaaaccggtaaacgtaacccgtaaaggtaccgtcgggactaccgaccgttaaccgtctaccgtttcgtaccgttccgttaacccgtttaccccaacgttacgtacgttacgaaacctcgttaagtaacccg

SEQ ID NO: 16813 - DNA, 778 bp, Homo sapiens
  misc_feature: GYAE6OF01DG4PE.9.12.B01.1.454.CMB.1.raw
  modified_base (574)..(574): a, c, t, g, unknown or other
  misc_feature (574)..(574): n is a, c, g, or t
  modified_base (706)..(706): a, c, t, g, unknown or other
  misc_feature (706)..(706): n is a, c, g, or t
  modified_base (772)..(772): a, c, t, g, unknown or other
  misc_feature (772)..(772): n is a, c, g, or t
tcagtgatacgtctcacgaccggtgctcgatttagtagtgtagattccgcgggcagcaagatggtgttgcagacccaggtcttcatttctctgttgctctggatctctggtcgccgtacgggacatcgtgatcgaccctagtcctccgaagcctcccgtggctgtcgtctcgtgggacgaggacggcccaaccatactaacgcgacgaacgtccgacgcctaaggtagtttacggttttaacgaccggtacctaccgaaacaaaaacctaaacggtaaacgttacgttagtaccggttaggttaactacgaacgaaccgaaacgtaaaaccgacggaacctacgtacccttaaacctaaacgtctacctaacgtaacgttaacggtcggtacctaaccgttacccgaaaacccggtacgtaacccgggttcccggggttaccctaggaaccggttaacttcggaaggtccggttacgacggggtaccggttacggtaccggaacgtacttactttacccacctactaccgaacttacgcgacgtacgaccgtctgggaaccttagactaaggtntacgcggttacggtaacctttaagtttaacgtacgttacggaaccttaaccgttcggttttccgacgggttacgtacgggtaaaccgaacggtaaacggtaacgaacgggttaaacaaccgtaacgttacgnggtcgaactccgatactagtcgtgaacttcaacgtcctaccgtacgtataccggtataacccggtntacccg

SEQ ID NO: 16814 - DNA, 802 bp, Homo sapiens
  misc_feature: GYAE6OF01DQDVT.9.12.B01.1.454.CMB.1.raw
  modified_base (91)..(91): a, c, t, g, unknown or other
  misc_feature (91)..(91): n is a, c, g, or t
  modified_base (300)..(300): a, c, t, g, unknown or other
  misc_feature (300)..(300): n is a, c, g, or t
tcagtgatacgtctcacgaccggtgctcgatttagtagtgtagattccggcgggggagctacaacaggcaggcaggggcagcaagatggtntgcagacccaggtcttcatttctcttgttgctcgtaggacttcgttcgtggtcgaccgtacggggactactcgtagatcggacccagtctaccagtacctccgtgcttgtcgtctcggtcgggacgaggaccggtccaacctagtaaccaacgtgacctaaacgtccgacgacaggtacgttttaggttttacaccggctacccgaaanaaacgaacgttaacttacgtacgtcgttaggtacacgacggtacaaacgtaaacggacgacgtaccgtaccttaacgtaactcgacttcgtaaaccggtacgtcggacttaaccgtaccggtacccggtaactaccgggttcccgtaccctggtaaactcttagggagtcgtacgcggtcggttacaggacctagttaccttcaaccttctaaccgtacctaacgcgttaacgccgtaacgtccgtacgaccggtaggtcgttaacgaagggttaccgttggggttaccgttaaggtttaacggttttcgttaaccggttaacgtttaacccgtaaaggtttttccgggtttaccggggttacgggttacccggttaacgggttaccggaaaacggtaccggtaagggtaaaccgtaaaccggtaaacgtaaacggtacgttacggtagtcccgtacgaacttaccggttagtacccgtttgtttacccgtccttaccccgg

SEQ ID NO: 16815 - DNA, 770 bp, Homo sapiens
  misc_feature: GYAE6OF01DCMPG.9.12.B01.1.454.CMB.1.raw
  modified_base (620)..(620): a, c, t, g, unknown or other
  misc_feature (620)..(620): n is a, c, g, or t
  modified_base (642)..(642): a, c, t, g, unknown or other
  misc_feature (642)..(642): n is a, c, g, or t
tcagtgatacgtctcacgaccggtgctcgatttagtagtgtagattcggcgggggggggtctcaggaggcagcgctctcaggacgtcacaccatggcctgggctctgctcctcctcaccctcctcactcagggtcacgagggtcctggcccagtctcgccctggacctcgacgtccctccctccggtcgtcccgggtctcccgtggaacctcggtccggtacaccgtatccgttccctggacctaagtccggaacccagtcaagtgaactaggtttggtctaccttaataacgttatgtaccttccgtacggtaaccaaccgtacgacccaacccgtaggaaacctaaaaccggtaccccctaaaactccgtaagttacgttaagtttaagtaggtaaacggttacaaagtaaccgggccgtcccgttcggtccgggtaccttgacgttcgtcttcgttcggtcggtcccttacggaacgttccgtacggacccgaaacgtcccggtaccccgtacgtccggtaaccttccgtcgggtcggtccctaccggacggtacttcggacgtagtccggtaggtacttagttatttccgttagaccgtcgacgtactctagtcgntaaccggacgtaccacgtaacnttaccggttagtaccgggtagtaccgtacccggtacgtacccggtcgttaccgttacggccgttaaccggacccgtaaaccggtaaccccctaccgtaccgttccgaacccttcccgggttaaccccc

SEQ ID NO: 16816 - DNA, 735 bp, Homo sapiens
  misc_feature: GYAE6OF01CGH4C.9.12.B01.1.454.CMB.1.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (718)..(718): a, c, t, g, unknown or other
  misc_feature (718)..(718): n is a, c, g, or t
tcagtgatacgtctcacgaccggtgctcgatttagtagtgtagattcggcggggggggtctcaggaggcagcgctctcaggacgtcaccacatggcctggctctgctcctcctcaccctctcactcgagggcacgacgggtcctcgggccctagtcgtcgccctgacctcacggccctcctccgcgtccgggtctccgtaggaccagtccggtacaccntcctcgtgcacgtggaaccngcctaggtgactagttggtntacttaatactagttcttctaccgtacggtaccaacgtacgaccaccggagtacctaaaccgtaccccaaactccagtgtaattacgtggtaagtacaagtacggtccggtccttacggtcgggtcctagtacgtccgttcttccgtgtcggtaccttccgaaaggtcgtacggtaaccaaccgtccgacccgttcccgtacggtaccccgtcggttaccggtccggaccctaccgggtacggtaccgacggtacgtacgtagggacggttacgtaacggtttaactttaccggttactaccgggtacttaccggtcctaacgtacgtacgtccggacctaccggaaccctaccctaagtaaccgtttcgaccggtaagggccggttaccggacccgtccgtaaccgtcccgttacgaccggtacgacccgaccgacccgtaaccctaccggtagtccncccgttgtacccccggg

SEQ ID NO: 16817 - DNA, 704 bp, Homo sapiens
  misc_feature: GYAE6OF01CE6BQ.9.12.B01.1.454.CMB.1.raw
  modified_base (291)..(291): a, c, t, g, unknown or other
  misc_feature (291)..(291): n is a, c, g, or t
tcagtgatacgtctcacgaccggtgctcgatttagtagtgtagattccgcgggggagctacaacaggcaggcagggggcagcaagatggtgttgcagacccaggtcttcatttctctgttgctctggatctctggtgccgtacggggacatcgtgatgacccagtctccagactcctggctgtgtctcgtgggcgaggacgggaccaaccatacaacgtgacaacgtccacgccagtagtttgttttacacggcctaccgaacaaacaaagaactacttagcgttagtacncagacaacgaaaccgaggaaccacgaccctaccgtaaactcgtacctactaacgttaacgtacgggactacgtacccgtaccggactaacggtcccgggtcctacggaccgtatacgaggtcggacgacgggtcggtcgtagggacagttacttccgacttccacctacacgtcacgacgtacgcctaggacgtacggactaaggacggtagtcggtagttacgttacgttttaacttacgtattaaccgtaagtttccggtttacggtccgggttaccggttaccggaaccggtaaacggggtaacccgtaagggaaaacggttaaactaaacccggtaaacgggtacccgtaggggtacgtaccgtaacgtacccgtaacttactccgttaccttccgttaaccttacccg

SEQ ID NO: 16818 - DNA, 683 bp, Homo sapiens
  misc_feature: GYAE6OF01BBREP.9.12.B01.1.454.CMB.1.raw
  modified_base (395)..(395): a, c, t, g, unknown or other
  misc_feature (395)..(395): n is a, c, g, or t
  modified_base (617)..(617): a, c, t, g, unknown or other
  misc_feature (617)..(617): n is a, c, g, or t
  modified_base (642)..(642): a, c, t, g, unknown or other
  misc_feature (642)..(642): n is a, c, g, or t
tcagtgatacgtctcacgaccggtgctcgatttagtagtgtagattccgcgggcagcaagatggtgttgcacgacccaggtcttcatttctctgttgctctggatctctggtcgccgtacgggacatcgtgatgaccagtctccagtacctccctggctgtgtctcgtggcgacggaggcccacatcactgacaactccagccgagtagttgtttaacgccggtcctaccgaacaacaacgtaacttacgtagtccgttgactacagacaaacgtaaccaggactacgacccttaacctaaacgtgtacctataagttaacggcggaacctcgtaccgacccggtacggtaacccggttcccgggttacccgtaccggtaccgtagttaaccggnggttaccggacggtacggtccgggggttacgacgggaccttaagtaccttccctaacgttaccctacctaccgtaactaccgacgacgtaccgtccggtacgacgtagggacgtagaaacggtgttcgtaccgttagtttaacgtttacgtacgtagtacgtacgttcgttacgtcggtcggtaccgacgaaccggtaagtacgtaacgtaagactaaacgngtacgtcgagtcgactcgactcgtntacgtctcgtccctccgtatacgataacggtcgtagtaccg

SEQ ID NO: 16819 - DNA, 501 bp, Homo sapiens
  misc_feature: GYAE6OF02IZ04N.9.12.B01.1.454.CMB.1.raw
  modified_base (415)..(415): a, c, t, g, unknown or other
  misc_feature (415)..(415): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttatactgtcaactagttttcncgggcgttcggccaaggaccaaggtgaaatcgaaacgaactgtgctgcaccatctgtcttcatcttcccgctactctagagactac

SEQ ID NO: 16820 - DNA, 504 bp, Homo sapiens
  misc_feature: GYAE6OF02IYO43.9.12.B01.1.454.CMB.1.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagntgtggcagtttatactgtcaacngttttcncgggtcttcggaccaacgggaccgaaggtaggaaattaaacgaactgtgctgcacatctgtctcatccttccgccatctagatacgtatac

SEQ ID NO: 16821 - DNA, 501 bp, Homo sapiens
  misc_feature: GYAE6OF02IVLWQ.9.12.B01.1.454.CMB.1.raw
  modified_base (414)..(414): a, c, t, g, unknown or other
  misc_feature (414)..(414): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagatttcactctcaccatcagcagcctgcaggctgaagatgtggctagtttatactgtcaactagttttcncgggtcgttcggccaagggaccaaggtgaaatcaaacgactgtgctgcacatctgtcttcatccttcccgctactctgacgacgtac

SEQ ID NO: 16822 - DNA, 523 bp, Homo sapiens
  misc_feature: GYAE6OF02H8XE5.9.12.B01.1.454.CMB.1.raw
  modified_base (325)..(325): a, c, t, g, unknown or other
  misc_feature (325)..(325): n is a, c, g, or t
tcagtgatacgtctcacgaccggtgctcgatttagtagtgtagattccgcggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaacggctccgacaacaagaactacttagcttggtatcagcagaaaccaggacagcctacctaaactgactcattaactggcatctacccggnaagtccgggtcctgaccgattcagtgcagcgggtctgggacagatttcactctcacatcgagcagcctgcaggctgaagatgtgcgtagttagttactagtactaactagttacgttcggtcgtcgtcgtacgacgaacgacgaagtacgaaacgaacgtaacgtagtacgtacgtcgacgactactacgtcgtctac

SEQ ID NO: 16823 - DNA, 489 bp, Homo sapiens
  misc_feature: GYAE6OF02JXXXD.9.12.B01.1.454.CMB.1.raw
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctaccggcaatccgggtcctgaccgattcagtggcagcggtctgggacagatttcactctcacatcagcagcctgcagctgagatgtgctagtttatactgtacaactagtttcncgggcttcggacagggactaggtagaaatacgaaacgactgngctgcacatctgtcttcatccgtccgcatctgtacgatac

SEQ ID NO: 16824 - DNA, 494 bp, Homo sapiens
  misc_feature: GYAE6OF02JXCIY.9.12.B01.1.454.CMB.1.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
tcagtgatacgtctcacgaccggtgctcgatttagtagtgtagattccgcggcagcaagatggtgttgcagacccaggtcttcatttctctgttgctctggatctctggtgcctacggggacagtcgtgatgacccagtctccagactccctggctgtgtctctgggcgaggaggccgaccatcaactgcaagtccagccagagtgttttanacggctccganaacaagaactacttagcttggtatcagcagaaaccaggacagcctctaaactgctnattaacgnggcatcaacccggnaacgtccggggtacctgaccgattcagtggcagcgggtctgggacagatttcactctcacagtcagcagctgcagtcngagangtgctagttatcngtcanattttcngggtctcgtgacggacaggtgaatgaaaccatgtaggntgacactatcgtcgtntcatctccgtccaatctacgganaccggtac

SEQ ID NO: 16825 - DNA, 497 bp, Homo sapiens
  misc_feature: GYAE6OF02GIPV0.9.12.B01.1.454.CMB.1.raw
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttaactctcacatcagcagcctgcaggctgaagatgtggcagtttatactgtcaacngttttcncgggcgttcggccaagggaccaaggtgaaatcaaacgactgtggctgcacatctgtcttcatcttcccgcatctgacgacgtatc

SEQ ID NO: 16826 - DNA, 498 bp, Homo sapiens
  misc_feature: GYAE6OF02G82L4.9.12.B01.1.454.CMB.1.raw
  modified_base (494)..(494): a, c, t, g, unknown or other
  misc_feature (494)..(494): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagatttcactctcaccatcagcagcctgcaggctgaagatgtggcagtttatactgtcaactagttttctcgggtcttcggccaagggaccaaggtggaaatcaaacgaactgtgctgcaccatctgtcttcatcttcccgcatctgtagngtac

SEQ ID NO: 16827 - DNA, 515 bp, Homo sapiens
  misc_feature: GYAE6OF02F1A7W.9.12.B01.1.454.CMB.1.raw
  modified_base (441)..(441): a, c, t, g, unknown or other
  misc_feature (441)..(441): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagtttttcncgggtcgttcggccaagggaccaaggtaggaatacgaaacgaactaggtgcgtgacaccatctcgtcttctacg

SEQ ID NO: 16828 - DNA, 515 bp, Homo sapiens
  misc_feature: GYAE6OF02JCBVN.9.12.B01.1.454.CMB.1.raw
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatacggctccgacaacaagaactacttagcttggtatcagcagaaaccaggacagcctcctaaactgcctnattaactgggcatctacccggcaactccggggtccctgaccgatttcagtggcagcggtctgggacagatttcactctcaccatcagcagcctgcaggctgaantgngcagtttattactgtcaactagttttcgcgggtccgttcggccgaaaggccgaagtggaatacgaaacgtaactgtaggctagcaccgatcgtacgttcttctac

SEQ ID NO: 16829 - DNA, 510 bp, Homo sapiens
  misc_feature: GYAE6OF02FTQDU.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaactagttttctcgggtcgttcggccgaagggaccaagggtaggaaatacgaaacgaacgtgtggctgcaccatctgtcttcatcttcccgcctatctgacgacgtac

SEQ ID NO: 16830 - DNA, 525 bp, Homo sapiens
  misc_feature: GYAE6OF02IAV21.9.12.B01.1.454.CMB.1.raw
  modified_base (360)..(360): a, c, t, g, unknown or other
  misc_feature (360)..(360): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaaccaggacagcctcctaaaactgctcattaactgggcatctacccggcaatccggggtccctgaccgattcagtggcagcgggtctgggacagatttcactctcnccatcagcagcctgcaggctgaagatgtggctagtttattactgtacaactagttttcgtcgggtcgttcggaccaaacgggaccgtaaggtaggaaatacgaaaacgaactggtaggctgacaccgatctgttctctactccttcccgcatctagtaacgatac

SEQ ID NO: 16831 - DNA, 501 bp, Homo sapiens
  misc_feature: GYAE6OF02HTFD1.9.12.B01.1.454.CMB.1.raw
  modified_base (411)..(411): a, c, t, g, unknown or other
  misc_feature (411)..(411): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactggcatctacccggcaatccggggtcctgaccgattcagtggcagcggtctgggacagatttcactctcacatcagcagcctgcaggctgaagatgtggctagtttatactgtactaactgttttcncgggtcttcggaccgaagggaccaagggtgaaatacaaacgaactgtggctgcacagtctcgtctcacttctcccgcatctagacgatac

SEQ ID NO: 16832 - DNA, 505 bp, Homo sapiens
  misc_feature: GYAE6OF02G5J1P.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccgggtccctgaccgattcagtggcagcggtctgggacagattcactctcaccatcagcagcctgcaggctgaagatgtggcagtttatactgtcaactagttttctcgggtcgttcggccaagggaccaaggtgaaatcgaaacgtaactgtagcgtgcacatctgtcttcacttcttcccgcactctacgtagacgtac

SEQ ID NO: 16833 - DNA, 567 bp, Homo sapiens
  misc_feature: GYAE6OF02IFYPT.9.12.B01.1.454.CMB.1.raw
  modified_base (217)..(217): a, c, t, g, unknown or other
  misc_feature (217)..(217): n is a, c, g, or t
  modified_base (441)..(441): a, c, t, g, unknown or other
  misc_feature (441)..(441): n is a, c, g, or t
tcagtgatacgtctcacgaccggtgctcgatttagtagtgtagattccggcgggcagcaagatggtgttgcagacccaggtaccttcatttctctgttgctctggatctctggtgcctacggggacatcgtgatgacccagtctccagactccctggctgtgtcctcgtgggcgagagggccaccatcaactggcaagtccagccagagtgttttanacggctccgacaacaagaactacttagcttggtatcagctagaaacctaggacagcctcctaaaactgctcagttaacctgggacactctaacccggcaagtccggggtccctggacccgatttccaacgtcggcaggtcgggtctggggacaggtatttcactctcaccgatcagcagcctcgcaggctgaaagactgtaggctagtttattacgtgttcaangttttctcgggcttcggacgaacggaccgaacggtagaacgtactaaacgtaacgtgtacggctacgcaccgagtcctcgtcttcgaacttccgtcccgaccgtacttccgtagtacgtacgtacg

SEQ ID NO: 16834 - DNA, 516 bp, Homo sapiens
  misc_feature: GYAE6OF02I99YC.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttcgtcgggtcgttcgggccgtaagggaccaagggtaggaaatcgaaacgaactgtgctgcacatctgttcttcattcctttccgcctatctacgagtacgtac

SEQ ID NO: 16835 - DNA, 492 bp, Homo sapiens
  misc_feature: GYAE6OF02GIT4F.9.12.B01.1.454.CMB.1.raw
  modified_base (412)..(412): a, c, t, g, unknown or other
  misc_feature (412)..(412): n is a, c, g, or t
  modified_base (480)..(480): a, c, t, g, unknown or other
  misc_feature (480)..(480): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggttctgggacagatttcactctcaccatcagcagcctgcaggctgaagatgtgcagtttatactgtcaactgttttcncgggtcgttcggccaagggaccaaggtgaaatcgaaacgactgtgctgcacatctgtctcatctcccncatctgagctac

SEQ ID NO: 16836 - DNA, 517 bp, Homo sapiens
  misc_feature: GYAE6OF02IKTHY.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctacctaaactgctcattaactgggcatctacccggcaatccggggtccctgaccgattcagtggcagcgggtctgggacagattcactctcaccatcagcagcctgcaggctgaagagtgtggcagtttatactgtcaactgttttcgcggtcgtcgccgaaggacaaggtgaaactacgaaacgaacgtggtacggctagcaccatctacgtcttacacgttcttcccgactactcgtagacgtacgtac

SEQ ID NO: 16837 - DNA, 640 bp, Homo sapiens
  misc_feature: GYAE6OF02I3ZVK.9.12.B01.1.454.CMB.1.raw
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (404)..(404): a, c, t, g, unknown or other
  misc_feature (404)..(404): n is a, c, g, or t
tcagtgatacgtctcacgaccggtgctcgatttagtagtgtagattccgcaggcagcaagatggtgttgcagacccaggtcttcatttctctgttgctctggatctctggtgcctacggggacagtcgtgatgacccagtctccagactccctggctgtgtctctgggcgagagggccatcatcaactgacaagtccagccagagtgtttatacgctccgacaacagaactacttagcttggatcagcagaaccaggacagcctctaaactgactcaattaacngggacatctaccggcaacgtcccggggtcctgacccgattccgagtcggcaggcgggtctgggacaggtntttcgactctccactatcagccagtccctgcgaggcttagaagagttcgnggtctaggttttactacgttagttacaaacttcgtttttaccgcggggttaccgtttcgggacccggttaaacgggacccgtaaagggttaacggggtaaacttaaccggtaaacgtaaaccgttgggttaacggtcgtcggaacccgtaacccgtacgttacgtccgtttaccgtttactaccgtttacccgtttcccccggaccgtttaaccgttaccggttacggtaaaacgg

SEQ ID NO: 16838 - DNA, 633 bp, Homo sapiens
  misc_feature: GYAE6OF02IFZAI.9.12.B01.1.454.CMB.1.raw
  modified_base (234)..(234): a, c, t, g, unknown or other
  misc_feature (234)..(234): n is a, c, g, or t
  modified_base (340)..(340): a, c, t, g, unknown or other
  misc_feature (340)..(340): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttanacggctccgacaacaagaactacttagcttggtatcagcaagaaaccaggacagcctacctaaactgctcaattaactggcatctacccggcaacgtccgggtccngaccgattcagtggcaggccgggtctgggacagtactttcactctcaccatcagcagcctgcaggctagaaacgtatggtcggactagttttaacttacgttacggtacctaaacgttacggttttttaccggtccgggggtcccgttttaccgggaccgtaaacgggggtaaccctaaggggtacgggtaaaacgtttaaccgaaaaccggttaaaccggttacgggtacgggtaccgttccggaccgtaacccgttaacgttccgtttacgtttccgttacccttaacccg

SEQ ID NO: 16839 - DNA, 503 bp, Homo sapiens
  misc_feature: GYAE6OF02HSD0E.9.12.B01.1.454.CMB.1.raw
  modified_base (417)..(417): a, c, t, g, unknown or other
  misc_feature (417)..(417): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtctaacagtttttcncggggtcgttcggccaagggaccaaggtggaaatcaaacgaactgtgctgcaccatctgtctcatctccgcatctagacgacgtac

SEQ ID NO: 16840 - DNA, 504 bp, Homo sapiens
  misc_feature: GYAE6OF02INKD3.9.12.B01.1.454.CMB.1.raw
  modified_base (413)..(413): a, c, t, g, unknown or other
  misc_feature (413)..(413): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtgcagtttatactgtcaactagttttcncgggtcgttcggccaagggaccaaggtgaaatcaaacgaactgtgctgcaccatctgtcttcacttccttcccgccatctagacgacgtac

SEQ ID NO: 16841 - DNA, 544 bp, Homo sapiens
  misc_feature: GYAE6OF02H6PIV.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttataccggctccgacaacaagaactacttagcttggtatcagcagaaaccaggacagcctcctaaactgctcattaactgggcatctacccggcaatccgggtccctgaccgattcagtggcagcgggtctgggacagattcactctcacatcagcagcctgcagctgaagatgtggcagtttattactgtcaactagttttctcgggtcgttccggaccgtaacgggaaccgaagggtacggaaactacgaaaacgaacgtaggtacggactcgactaccaagtcgtagtcttcctacttccgttcccgcctacttcctagtaacgtacgttaacg

SEQ ID NO: 16842 - DNA, 523 bp, Homo sapiens
  misc_feature: GYAE6OF02GLO1X.9.12.B01.1.454.CMB.1.raw
  modified_base (211)..(211): a, c, t, g, unknown or other
  misc_feature (211)..(211): n is a, c, g, or t
  modified_base (385)..(385): a, c, t, g, unknown or other
  misc_feature (385)..(385): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaaacaagaactacttagcttggtatcagcagaaaccaggacagcctcctaaactgctcattaactgggcatctacccggcaagtccggggtcctgaccgattcagtggcaggcggtctgggacagtatttcactctcaccatcagcacgctgcaggctgaagntgtgctagtttatacgtgtcaacttgtttccgcgggtctcggacgaaggacgtaagggtagaaacgtacgaaacgtaacgtgtcgctacgcactacgtctgttcctctactccttccgcctagtctaggacgtatacg

SEQ ID NO: 16843 - DNA, 514 bp, Homo sapiens
  misc_feature: GYAE6OF02GPBMM.9.12.B01.1.454.CMB.1.raw
  modified_base (412)..(412): a, c, t, g, unknown or other
  misc_feature (412)..(412): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagattcactctcacatcagcagcctgcaggctgaagatgtgctagtttattactgtcaactagttttcncgggtcgttcggccgaagggaccaggtgaaatcaaacgactagtggctgcaccagtctcgtcttactacttcttcccgcctatccgtagacgtacgttaacg

SEQ ID NO: 16844 - DNA, 584 bp, Homo sapiens
  misc_feature: GYAE6OF02IJ2RB.9.12.B01.1.454.CMB.1.raw
  modified_base (426)..(426): a, c, t, g, unknown or other
  misc_feature (426)..(426): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggacagcctacctaaactgctcaattaactgggcatccgtacccggcaaatcccggggtccctgaccgattcagtggcagcgggtctgggacagatttcactctcacatcagcagcctgcaggctagaagatggtggctaagtttatactgtacaaactgttttccncgggcgttcggacctaaacgggaaccgaagggtaggaaaacttaccgaaaacgaaaccgtggtacggtactaggcctaaccgtaactcgttacgtaccctttcaaccgttcctttaccccgtccgtaaaccttcgtacgtaaacggtaacggttaacc

SEQ ID NO: 16845 - DNA, 516 bp, Homo sapiens
  misc_feature: GYAE6OF02IKHN6.9.12.B01.1.454.CMB.1.raw
  modified_base (407)..(407): a, c, t, g, unknown or other
  misc_feature (407)..(407): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagccctcctaaactgctcattaactgggcatctacccggcaagtccgggtccctgaccgattcagtggcagcgggtctgggacagatttcactctcaccatcagcagcctgcaggctgaagntgtgctagtttattactgtacaactgttttctgggcgttcggccgaagggaccgaaggtaggaaatacgtaaacgaactggtggctagcctaccagtctcgttctctac

SEQ ID NO: 16846 - DNA, 506 bp, Homo sapiens
  misc_feature: GYAE6OF02FXB35.9.12.B01.1.454.CMB.1.raw
  modified_base (496)..(496): a, c, t, g, unknown or other
  misc_feature (496)..(496): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtcctgaccgattcagtggcagcgggtctgggacagatttcactctcaccatcagcagcctgcaggctgagatgtgctagtttattactgtcaactagttttcgtcgggtcgttcggccgaagggaccaagggtagaaactacgaaacgaactgtgctgacacatctgtctcactcttcccgcatcngacgacgtac

SEQ ID NO: 16847 - DNA, 501 bp, Homo sapiens
  misc_feature: GYAE6OF02GB3CP.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccaaggtaggaaatcaaacgaactgtgctgcaccatctgtcttcatcttcccgcctatctgagactac

SEQ ID NO: 16848 - DNA, 572 bp, Homo sapiens
  misc_feature: GYAE6OF02H70HW.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctacctaaactgctcattaactgggcatctacccggcaatcccgggtccctgaccgattcagtggcagcggtctgggacagatttcactctcaccatcagcagcctgcaggctgaagatgtggctagtttattactgtcaaacgtgttttcgtcgggtcgttcggaccgaagggaaccgtaagggtaggaaagtaccgaaaacgtaaccgtaggtacgggtctcgaccacctaagttccgttacgtttccttacctacgttcccgtttccccgacctaccttccgtaacgtaacggtacgttaaccg

SEQ ID NO: 16849 - DNA, 513 bp, Homo sapiens
  misc_feature: GYAE6OF02IFDRF.9.12.B01.1.454.CMB.1.raw
  modified_base (382)..(382): a, c, t, g, unknown or other
  misc_feature (382)..(382): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaacgtccggggtcctgaccgattcagtggcagcggtctgggacagatttcactctcacatcagcagcctgcaggctgaagntgtgctagtttatactgttacaactagttttcgcgggtcgtcgacgaacggaccgagtagaactacgaaacgacgtgtgctgacacatctgtctctacttcccgttccgcctactctacgtacgtagtacg

SEQ ID NO: 16850 - DNA, 514 bp, Homo sapiens
  misc_feature: GYAE6OF02GELDI.9.12.B01.1.454.CMB.1.raw
  modified_base (411)..(411): a, c, t, g, unknown or other
  misc_feature (411)..(411): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagatttcactctcaccatcagcagcctgcaggctgaagatgtggcagtttatactgtcaactgttttcncgggtcgttcggccgtaagggaccgtaaggtggaaactcgaaaacgaactgtgactgacaccgtatcgtgtcttactatccttcccgctactctagagactac

SEQ ID NO: 16851 - DNA, 522 bp, Homo sapiens
  misc_feature: GYAE6OF02IBRGJ.9.12.B01.1.454.CMB.1.raw
  modified_base (222)..(222): a, c, t, g, unknown or other
  misc_feature (222)..(222): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccganaacaagaactacttagcttggtatcagcagaaaaccaggacagcctcctaaaactgctcattaactgggcatctacccggcaatccgggtccctgaccgattcagtggcagcggtctgggacagatttcactctcaccatcagcagccctgcaggctgaagatgtggctagtttatactgtacaactagttttctcgggtcgttcggcctaaagggacctaaagggtaggaaatacgaaaacgtaactagtacggctgacaccatctgtcttcattccttcccgctatctagagacgtac

SEQ ID NO: 16852 - DNA, 536 bp, Homo sapiens
  misc_feature: GYAE6OF02GHM4J.9.12.B01.1.454.CMB.1.raw
  modified_base (236)..(236): a, c, t, g, unknown or other
  misc_feature (236)..(236): n is a, c, g, or t
  modified_base (420)..(420): a, c, t, g, unknown or other
  misc_feature (420)..(420): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctccgacaacaagaactactagcttggtatcagcagaaaccaggacagcctacctaaactgactcaattaacgtgggctatcctacccggcaacgtccgggtcctcgaccgtattcagtggcaggcgggtctgggacaggtactttcactctcaccatcagcagcctgcaggctagaagngtgtgactagtttacttacgtgtacactgtttcgtcgggtcgttcggacgaacggtacgaaggtagaacgtacgaaacgtaacgtaggtagcgtgacactatcgtcttctctaccg

SEQ ID NO: 16853 - DNA, 539 bp, Homo sapiens
  misc_feature: GYAE6OF02GPUGN.9.12.B01.1.454.CMB.1.raw
tcagtgatacgtctcacgaccggtgctcgatttagtagtgtagattccgcgggcagcaagatggtgttgcagacccaggtcttcatttctctgttcgctctggatctctggtgcctacggggacagtcgtgatgacccaggtctccagactccctggctgtgtctctgggcgagagggccaccgatcaactgcaagtccagccagagtgttttatacggctccgacaacaagaactacttagcttggtatcagcagaaaccaggacagcctcctaaaactgctcattaactgggcatcctacccggcaaacgtccggggtccctgaccgattcagtggcaggcgggtctggggacagatttcgactctcaccatcagcagcctgcgaggctagaagatggtgactagttttatacgtgtactaactagttttcgcgggtcgttcggaccgaagggaccaagggtagaaatacgaaacgaacgtgtaggctgacacatctatcttctactccttccgtcctactcgtagacgtacgtacg

SEQ ID NO: 16854 - DNA, 556 bp, Homo sapiens
  misc_feature: GYAE6OF02JAOU8.9.12.B01.1.454.CMB.1.raw
  modified_base (210)..(210): a, c, t, g, unknown or other
  misc_feature (210)..(210): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttanacggctccgacaacaagaactacttagcttggtatcagcagaaaccaggacagcctcctaaactgctcattaactgggcatctacccggcaatccggggtcctgaccgattcagtggcagcggtctgggacagatttcactctcacatcagcagcctgcaggctgaagatgtgctagtttactatgtacaactagttttccacggggttcctcgggaccaacgggaaccgtaagggtagtaaacgtacaaaaccggaaccgttaggtacggtcgttacgctaaccgacgttacttcgttaccgttcacgttaccttcccggaccctagtcctaggactacgttaac

SEQ ID NO: 16855 - DNA, 499 bp, Homo sapiens
  misc_feature: GYAE6OF02HFUMN.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctaccggcaatccgggtcctgaccgattcagtgcagcggtctgggacagattcactctcaccatcagcagcctgcaggctagaagatgtgctagtttatactgtcaactgtttcgtcgggtcgttcggcaagggaccaaggtagaaactacaaacgaactgtagctgcacatctgtcttcactccttccgccatctagacgtagtac

SEQ ID NO: 16856 - DNA, 596 bp, Homo sapiens
  misc_feature: GYAE6OF02I0UT3.9.12.B01.1.454.CMB.1.raw
  modified_base (212)..(212): a, c, t, g, unknown or other
  misc_feature (212)..(212): n is a, c, g, or t
  modified_base (413)..(413): a, c, t, g, unknown or other
  misc_feature (413)..(413): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttanacggctccgacaacaagaactacttagcttggtatcagcaagaaaccaggacagcctcctaaactgctcattaactgggactatacctaccccggacaacgtccggggtccctcgacccgtattccagtcggacaggccgggtcgtaggggacaggtatttccgactcgtcaaccatccagcagccctgcaggctagaagntgtgctagtttatactgtactaatgtttcgcggtcgtcggaccaagggaccaagggttacgaaacgttacgaaacgtaacgtggtacggcgtagaccaccgacgttccgttacgttccgtttaacgtaccgttcccgttccccgtaccttaccgtaccgtaacgtaccggtaaccgttaaccg

SEQ ID NO: 16857 - DNA, 543 bp, Homo sapiens
  misc_feature: GYAE6OF02GJXDK.9.12.B01.1.454.CMB.1.raw
  modified_base (211)..(211): a, c, t, g, unknown or other
  misc_feature (211)..(211): n is a, c, g, or t
  modified_base (384)..(384): a, c, t, g, unknown or other
  misc_feature (384)..(384): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcaagaaaccaggacagcctcctaaactgctcattaactgggcatcctacccggcaacgtccggggtccctgaccgattcagtggcagcgggtctggggacagatttcactctcaccatcagcacgcctgcaggcngaagatgtgctagtttatctgtacaacttgtttctcgggtcgttcggaccgaacgggaccgaaggtagaaacgtacgaaacgtaacgtgtggctacgcaccagtcttagtccttactacttcccttcccgtcctacgttcctagtaacgtagttaaccg

SEQ ID NO: 16858 - DNA, 532 bp, Homo sapiens
  misc_feature: GYAE6OF02G88I6.9.12.B01.1.454.CMB.1.raw
  modified_base (364)..(364): a, c, t, g, unknown or other
  misc_feature (364)..(364): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacagatttcactctcaccatcancacgctgcaggctgaagatgtggctagtttatactgtacacttagtttcgtcgggtcgttcggccgaagggaccgaagggtacggtaaatacgtaaacgaacgtagtcggctgacaccagtctagttcctacctatccttcccgactacgtactacgtacgacttacg

SEQ ID NO: 16859 - DNA, 542 bp, Homo sapiens
  misc_feature: GYAE6OF02JGINW.9.12.B01.1.454.CMB.1.raw
  modified_base (211)..(211): a, c, t, g, unknown or other
  misc_feature (211)..(211): n is a, c, g, or t
  modified_base (355)..(355): a, c, t, g, unknown or other
  misc_feature (355)..(355): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaatccggggtccctgaccgattcagtggcagcggtctgggacagatttcactcncaccatcagcagcctgcaggctgaagagtgtggctagtttattactgtactaacgtacgttttccgcggggtcgttcggaccgtaacgggaccaagggtcggaaataccgaaaacgtaactcggtggtctcgaccacagtctgtcttcctattcccgttcccgccagttctacggtaagtacttacg

SEQ ID NO: 16860 - DNA, 628 bp, Homo sapiens
  misc_feature: GYAE6OF02GV9OH.9.12.B01.1.454.CMB.1.raw
  modified_base (328)..(328): a, c, t, g, unknown or other
  misc_feature (328)..(328): n is a, c, g, or t
tcagtgatacgtctcacgaccggtgctcgatttagtagtgtagattccgacgggcagacggaaggaatggtgttgctaggaccccaggtcgttaccatttcgtactcgttgctcctggattctcttcggtcgcctacggggacatcggtgactgaccctacgtccgtccagtactcctggctgtgtctctgggcgacgagggcctacgatcaacgtagcaacgtccagccagacgtggttttacacggctccgacaacaaggaactacttacgtcttggtatcagacaagaaaccaggaccaggcctcctaaacgtcgctcattaacngggcatctaccgcaactaccggggtcctcgaccgtattcaacgtcggacgaggcggggtctggggacagtattcgactcgtcacatcagcacgcctgcacggtcagaagtagtcgtcgataggtttacttacgtagttactaacgttgttttcgtcgggtcgttcggaccgtaagggtaccgaacggtacggtaacgtaccgaaacgtacgttacggtacggtacgacgtacacgtacgtcgttagtccggttactaccgttccgtacccgtccgacttccgtacgtacgtacgttaccg

SEQ ID NO: 16861 - DNA, 645 bp, Homo sapiens
  misc_feature: GYAE6OF02IWHEK.9.12.B01.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgttttanacggctccgacaacaagaactacttagcttaggtatcagacaagaaaccaggacacgacctacctaaactgctcaattaactgggactagtacctacccggacaacgtccggggtccctacgaccgtacttcgaggtggacgacggcgggtacgtagggacagtacttacactctacacctactacacgacacgcctcgcgacggacgtagaagagtggtcgtacgtagtttattacttacgttactaacttacgtttcgttcgggttccgttccggtaccggaacgggtaacggtaacgggtacggtaacgtaaccgtaaaccggtaaccgttcggtaaaaaaaaaacggtcggtacgtaccgtaacccgtaaccgttaccgttaccgttaccgttaccgttacccg

SEQ ID NO: 16862 - DNA, 633 bp, Homo sapiens
  misc_feature: GYAE6OF02HYOBH.9.12.B01.1.454.CMB.1.raw
  modified_base (212)..(212): a, c, t, g, unknown or other
  misc_feature (212)..(212): n is a, c, g, or t
  modified_base (355)..(355): a, c, t, g, unknown or other
  misc_feature (355)..(355): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctccgacaaacaagaactacttagcttggtatcagcaagaaaaccaggacagcctacctaaactgctcattaactggcactccgtaccggcaacgtcccgggtccctgaccgtattcaggtgcaggcgggtctgggacngatttcactctcacatcagcagcctgcgaggctaggaaagagttggtcggtactaagttttacttacttagtaacctaaacgttcgtttttccgcggggttccgtttaccgggtaccgaaacgggtaaccgtaagggtacggtaaaagtaaccgtaaaacgtaaccgtaggtcggtacgtacgtaccaaccgtacgttccgttgttaccgtttacctaaccgtttcccgttaccccgtaccgtacttaccggtttaacggaaccgttaacgttaaccg

SEQ ID NO: 16863 - DNA, 523 bp, Homo sapiens
  misc_feature: GYAE6OF02HB486.9.12.B01.1.454.CMB.1.raw
  modified_base (388)..(388): a, c, t, g, unknown or other
  misc_feature (388)..(388): n is a, c, g, or t
  modified_base (475)..(475): a, c, t, g, unknown or other
  misc_feature (475)..(475): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggatcagcagaaaccaggacagcctcctaaactgctcattaactgggcatctacccggcaacgtccggggtccctgacccgattcagtcggcagcgggtctgggacagtatttcactctcaccatcagcagcctgcaggctagaagngtgtggactagtttactactgtcaagttcgtttcgcgggtcgttcggacgaagggaccgtaaggtgaaatcgaaacgactgtcgtcngcacatctgtcttacacttccttacccgctacgtctagtacgactacg

SEQ ID NO: 16864 - DNA, 511 bp, Homo sapiens
  misc_feature: GYAE6OF02F5801.9.12.B01.1.454.CMB.1.raw
  modified_base (344)..(344): a, c, t, g, unknown or other
  misc_feature (344)..(344): n is a, c, g, or t
  modified_base (416)..(416): a, c, t, g, unknown or other
  misc_feature (416)..(416): n is a, c, g, or t
  modified_base (496)..(496): a, c, t, g, unknown or other
  misc_feature (496)..(496): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcggtctgggacngatttcactctcaccatcagcagcctgcaggctgaagatgtggctagtttattactgtacaactagttttcncgggtcgttcggccgaagggaccaaggtggaaatacgaaacgaactgtggctggccacatctgtcttctactcgttcccnccatctgagcgtaac

SEQ ID NO: 16865 - DNA, 549 bp, Homo sapiens
  misc_feature: GYAE6OF02JC0CP.9.12.B01.1.454.CMB.1.raw
  modified_base (323)..(323): a, c, t, g, unknown or other
  misc_feature (323)..(323): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactggcatcacccggnaactccggggtccctgaccgattcagtggcagcgggtctgggacagatttcactctcacatcagcagcctgcaggctagaagntgtggntagtttattactgtacaactagttttcgtcgggtcgttcggaccgtaagggacccaagggtacgaaataccgaaacggtaacgttcggtaggtaccgtagaccgaacctacttaccgttcgttaccttactaacccg

SEQ ID NO: 16866 - DNA, 610 bp, Homo sapiens
  misc_feature: GYAE6OF02IESEO.9.12.B01.1.454.CMB.1.raw
  modified_base (366)..(366): a, c, t, g, unknown or other
  misc_feature (366)..(366): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggccgtgtctctgggcgagagggccaccatcaactgcaagtccagccagagtgttttatacggctccgacaacaagaactacttagcttggtatcagcagaaaccaggacagcctcctaaactgctcattaactgggcatcctacccggcaacgtccggggtccctgaccgattcgagtggcaggcggtcgtggacagtattcactctacaccntcagcagcctgcaggctagaagagtggtggactagtttaatactgtactaacttagttttcgtcgggtcgttccgaccgaaacgggtaccgtaaagggtacgaaacgtaaccgtaaacgtaccgttaggtacggtaccgtacgaccgtacccgtacttaccgtcggtttacccttacgtaaccttcccgtttacccccgtccgttaaccttccgtaacggtaaacgttaccgtacgttaacccg

SEQ ID NO: 16867 - DNA, 503 bp, Homo sapiens
  misc_feature: GYAE6OF02FU7FY.9.12.B01.1.454.CMB.1.raw
  modified_base (211)..(211): a, c, t, g, unknown or other
  misc_feature (211)..(211): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaatccggggtcctgaccgattcagtggcagcgggtctgggacagatttcactctcaccatcagcagcctgcaggctgaagntgnggcagtttatactgtacaactagttttcncgggtcgttcgcgaaggaccaaggtggaaatcgaaacgaactgtgctgcaccatctgtcttcattccttcccgctatctagacgactac

SEQ ID NO: 16868 - DNA, 526 bp, Homo sapiens
  misc_feature: GYAE6OF02HBNRH.9.12.B01.1.454.CMB.1.raw
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaaacaagaactacttagcttggtatcagcaagaaaccaggacagcctacctaaactgctacaattaacgtgggcatcctaccggcaacgtcccgggtcctgaccgattcagtgcaggcgggtctgggacagtacttcactctcacatcagcagcctgcagctagaagatgtgctagtttactatgtacaattagtttcgcgggtctcggtacgaacggtacgaggtaggaanacgtaacgaactaggtgcgtcgactacncgtctgttctctacttcgtcccgtcactcgtacgtagtatacg

SEQ ID NO: 16869 - DNA, 519 bp, Homo sapiens
  misc_feature: GYAE6OF02IME5X.9.12.B01.1.454.CMB.1.raw
  modified_base (234)..(234): a, c, t, g, unknown or other
  misc_feature (234)..(234): n is a, c, g, or t
  modified_base (403)..(403): a, c, t, g, unknown or other
  misc_feature (403)..(403): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcagaaaccaggacagcctcctaaactgctcattaactggcatctacccggcaacgtccgggtccctgaccgattcagtgcagcggtctgggacagattcactctcaccatcagcagcctgcaggctgaagntgtgctagtttatactgtactaactagttttcgtcgggtcgttacggaccgaaagggaccgaagggtagaaacgtacgaaacgtaactggtacgctagcacagtctgttctactac

SEQ ID NO: 16870 - DNA, 532 bp, Homo sapiens
  misc_feature: GYAE6OF02GWNQJ.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcatacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaacgtccgggtccctgaccgattcagtggcagcggtctgggacagatttcactctcaccatcagcagcctgcaggctgaagatgtgctagtttattactgtacaacttgtttccgtcggtcgttacggccgtaaagggaccgtaaggtagaaactcgaaacgtaactggtcgactcgcgaccattctagtccttctacgttcccttcccgacctacttcacgtaacgtacg

SEQ ID NO: 16871 - DNA, 639 bp, Homo sapiens
  misc_feature: GYAE6OF02I362Y.9.12.B01.1.454.CMB.1.raw
  modified_base (213)..(213): a, c, t, g, unknown or other
  misc_feature (213)..(213): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacagtcgtgatgacccagtctccagactccctggctgtgtctctgggcgagagggccaccatcaactgacaagtccagccagagtgttttanacggctccgactaaccaagaacctacttagcttggtatcagcagaaaccaggaacagccctactaaaactgaccttcaacttaactgggtaccactctaccccggaccaaacgtccccgggggtaccctcggaaccgtacttaccgaggtcggccaggccgggtacgtacggggactagacgttttacaaccttctacacctagtccaagccacgcccgtgcgacggtctaggaaggactggtggtactagtttacttaccgttagtacaaacttggtttaccgtcgggttccgtcggacccgaaggggtaacccgtaggtaagggtaaacctacgaaaccgtaaacgtcggttaggcctagaccgaccagttccgtcgttactaccttactccctacccgtctacgtctacggtacgtacgtacg

SEQ ID NO: 16872 - DNA, 555 bp, Homo sapiens
  misc_feature: GYAE6OF02IWV4X.9.12.B01.1.454.CMB.1.raw
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
  modified_base (428)..(428): a, c, t, g, unknown or other
  misc_feature (428)..(428): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcactgcaagtccagccagagtgttttanacggctccgaacaacaagaactacttagcttggtaatcagcaagaaaccaggacagcctacctaaaactgctacaattaacgnggacatccacccggcaacgtcccgggtccctgaccgattcgagtcggcaggtccgggtctgggacagtactttcactctaccacatcagcacgcctgacaggctaggaagntgtgacttagttattactgtactaagtacgttttcgacggtcgttcgacgaacgggtaacaagggtagaacgtcgaaaacggtaactaggtacggctacgacgtaccagttctacgttctactaccg

SEQ ID NO: 16873 - DNA, 579 bp, Homo sapiens
  misc_feature: GYAE6OF02ITOKC.9.12.B01.1.454.CMB.1.raw
  modified_base (441)..(441): a, c, t, g, unknown or other
  misc_feature (441)..(441): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttatacggctccgacaacaagaactacttagcttggtatcagcaagaaaccaggacacgcctacctaaactcgctacattaacgtgggcactctaccggacaacgtccggggtacctgaccgattcagtcggcaggcgggtctagggacaggtactttacactctacaccatcagcacgcctgcaggctagaagtatggtggactagtttatactagtctaagtagttttcncgggtcttaccggactaaacgggtaccgtaagggtaacgtaaagtacaaaacgtaacgtcggtgtacgtacgaccaacctacgttacgtcgttccttactacttaccgtcccgctaccgtctaagtaacggtataacg

SEQ ID NO: 16874 - DNA, 712 bp, Homo sapiens
  misc_feature: GYAE6OF02JFH9M.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagagttgttttagtacggctaccgaacaaacaagaactactagcgttaggtactcagacaagaaaccgagacagcctacctaaactcgcctactaattaacgtcggactactcccgtaccggactaacgtcccgggtacctacggaccgtattccgagtcggacgtacggcggtacgtacgggacctaggttacctttaccgaccttccctaccgaacctacgtaccaacggtcgtaccggtcctcgaccgtacggtaccgtaggtaacgtacggtcggtacgggtacgtttaacggttttaacgtttaacgtaccggttaaccgtaacgtttacggttttaccggttaccgggttaccggttccgggtaaaccggtaaaccgggtaacggtaagggttacgtaaacgtaaccggtaaaccggtaacgttacggtacggtacgtacgaccgtaccgtacgttccgttaggtaccctttacgtaccg

SEQ ID NO: 16875 - DNA, 519 bp, Homo sapiens
  misc_feature: GYAE6OF02G5XFZ.9.12.B01.1.454.CMB.1.raw
  modified_base (387)..(387): a, c, t, g, unknown or other
  misc_feature (387)..(387): n is a, c, g, or t
  modified_base (478)..(478): a, c, t, g, unknown or other
  misc_feature (478)..(478): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcaggcgggtctgggacagtatttcactctcaccatcagcagcctgccaggctagaagntgtggctagtttatactgtacaacgtgttttcgcgggtcttcgggccgaagggaccaaggtagaaagtacgaaacgtagtgtgctgacacntcgtgtcttcacttccttcccgctactctagaacgtactac

SEQ ID NO: 16876 - DNA, 530 bp, Homo sapiens
  misc_feature: GYAE6OF02ISTZK.9.12.B01.1.454.CMB.1.raw
  modified_base (365)..(365): a, c, t, g, unknown or other
  misc_feature (365)..(365): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcancagcctgcaggctgaagatgtggctagtttattactgtcaacgtagttttctcgggtcgttcggaccgaagggaccgtaagggtagtaaactacgaaacgtaactggtgcgtcgcaccatctcgtcttctacttccgttacccgcctatctagacgtacgtaacg

SEQ ID NO: 16877 - DNA, 683 bp, Homo sapiens
  misc_feature: GYAE6OF02J0932.9.12.B01.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacggctccgacaacaagaactacttagcttggtatcagcaagaaaccagacagcctacctaaactgctacattaacgtggacactaccgtacccggactaacgtcccggggttacccacggaccgtacttcgaggtcggacgacggtcggtcgtgggactagtactttcaacctctaccacctactaccgacgcacgtccctggaccgacgggtactaggaacgtacgttcggtacgggtactttaacggtttacttacgttacgttaccgtaacgtttaccggtttttaccgggtaccgggttaccggttcccgggtaacccggtaaacgggtaaccggtaacgggtaacggtaaaccgttaacggaaaccggttaacgttacgggtacggtacgtacgtacccggtaccgtaacgttccgtacgtttaccgttaccgttaaccg

SEQ ID NO: 16878 - DNA, 509 bp, Homo sapiens
  misc_feature: GYAE6OF02FNELM.9.12.B01.1.454.CMB.1.raw
  modified_base (415)..(415): a, c, t, g, unknown or other
  misc_feature (415)..(415): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcataactgggcatctacccggcaactccggggtccctgaccgattcagtggcagcgggtctgggacagatttcactctcaccatcagcagctgcaggctgaagatgtggctagtttatatgtacaacgtagttttcncgggtcgttcggacgtaaggaccgaggtagaaagtcaaacgtaacgtgtgctgcacagtctgtcttcattccttccgtccactctgagcgtacg

SEQ ID NO: 16879 - DNA, 692 bp, Homo sapiens
  misc_feature: GYAE6OF02JEDLK.9.12.B01.1.454.CMB.1.raw
  modified_base (239)..(239): a, c, t, g, unknown or other
  misc_feature (239)..(239): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagagttgttttanacggctccgaacaacaagaactacttagcttaggtatcagcaagaaaccaggacacgcctacctaaactcgactactaattaaccgtgggacctaactcccgtaacccggacaacggttcccggggtccctacggacccgtatttcgaggtcgggcagggtcgggtacgtaggggactaaggtactttccaacgttcctaccacctatacgacgccacgccgtgcgtacggactagggaagtagttcggacggtacgttaagttttaacgttaccgtacgttacctaaacggtttcggtttttccggtccgggggttaccgtttaccgggaacccggtaaacggggtaaccgtaaacggggttacggtaacgtaacccggtaaaccgtaacggttaggtaccggtacgtacgaccgtaaccgtacgttacggttaccgtccgtttacgtaccg

SEQ ID NO: 16880 - DNA, 561 bp, Homo sapiens
  misc_feature: GYAE6OF02IFI8R.9.12.B01.1.454.CMB.1.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagtgttttataggctccganaacaagaactactagcttggatnagcaagaacaggacagcctactaaactgctcaattaacgnggcatctacccggacaacgtcccgggtaccctaggacccgtattaccgagtggcgaggccgggtctaggacagtatttcactctcaccatcagcagctgacagctagaagntgtgntacgttattactcgtataacgtgttttccgcgggtacgtttcggaccgtaacgggaaccgtaaggtacggaaataccgtaaaacaacggttaggtcggtactacggaccaccgtattaccgttagttcccttatacccg

SEQ ID NO: 16881 - DNA, 495 bp, Homo sapiens
  misc_feature: GYAE6OF02JZV5W.9.12.B01.1.454.CMB.1.raw
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggatcagcagaaaccaggacagcctcctaaactgctcattaactgggcatctaccgcaagtccgggtcctgaccgattcagtgcagcggtctgggacagtatttacactctcacntcagcagcctgcngctgaagntgtgctagttatacngttcatgtttcnggtctcggcacggacaggtagaagtacaacgtactgtcgcgtcacactgtactgtctactactcttcccgactagtactagacgtacgtac

SEQ ID NO: 16882 - DNA, 577 bp, Homo sapiens
  misc_feature: GYAE6OF02H2EG6.9.12.B01.1.454.CMB.1.raw
  modified_base (286)..(286): a, c, t, g, unknown or other
  misc_feature (286)..(286): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaacngggcatctacccggcaactccggggtccctgaccgattcagtggcagcggtctgggacagatttcactctcacatcagcagcctgcagctgaagtatggtgctagtttactacgttagtactaacttagtttttccgtcggggtcgtttcgggacctaaacggggacccaaagggttaggaaaacgttaccgaaaaccgtaacgtaggtagggaccttgacctaacccagttccttcggttaccttctaacttcccttcccgacctacgttcctaggtaacgtacgttaac

SEQ ID NO: 16883 - DNA, 543 bp, Homo sapiens
  misc_feature: GYAE6OF02JHRA5.9.12.B01.1.454.CMB.1.raw
  modified_base (413)..(413): a, c, t, g, unknown or other
  misc_feature (413)..(413): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctaccggcaatccggggtcctgaccgattccagtggcagcggtctgggacagatttcactctcaccatcagcagcctgcaggctgaagatgtggcagtttatactgtactaacagttttcncggtcgtcggtccgaagggaccgtaaggtggtaaataccgaaacgaacgttagtgggtacctgccaccacgttcgtacgttcttcacttccgttccccgaccgtacttaccgtacgaacgtacgttaacg

SEQ ID NO: 16884 - DNA, 525 bp, Homo sapiens
  misc_feature: GYAE6OF02IDSKL.9.12.B01.1.454.CMB.1.raw
  modified_base (304)..(304): a, c, t, g, unknown or other
  misc_feature (304)..(304): n is a, c, g, or t
  modified_base (468)..(468): a, c, t, g, unknown or other
  misc_feature (468)..(468): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaaacaagaactattagcttggtatcagcagaaaccaggacagcctactaaactgctacattaactgggcatcctaacccggnaacgtccggggtccctgaccgtatcgagtggcagcgggtctgggacagtatttcactctcacatcagcagcctgacagctagaagatgtagctagtttatatgtacaattgtttcgacgggtcgtcgaccgtaaggaacaggtagaaatacgaaacgtataggngtcgtacgacgactatcgtcgtactcctactcttcccgctactcgagtacgataacg

SEQ ID NO: 16885 - DNA, 535 bp, Homo sapiens
  misc_feature: GYAE6OF02H8QLK.9.12.B01.1.454.CMB.1.raw
  modified_base (412)..(412): a, c, t, g, unknown or other
  misc_feature (412)..(412): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcacatcagcagcctgcaggctgaagatgtgcagtttatactgtacaactgttttcngggtcttggaccgaacggaaccgaaggtaggaaactacgaaacgtaaacgtgtgactgaccaacacgttctagttccttctacttccttaccccgcctacgtactagtaacggacgttaaccg

SEQ ID NO: 16886 - DNA, 575 bp, Homo sapiens
  misc_feature: GYAE6OF02IQRZG.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaactccggggtccctgaccgattcagtggcagcgggtctgggacagacttcactctcaccatcagcagcctgcaggctagaagtatgtggtactagttttattacgtgttactaacttacgttttaccgtcggggtccgttccgggtaccgtaaggggacccgtaaagggtaacggaaataccgaaaaccgtaacgttcggtacggtactaggcctaccacgtctgttccttctaacgttctttacccgcctacttctagtacgtacgtaaccg

SEQ ID NO: 16887 - DNA, 682 bp, Homo sapiens
  misc_feature: GYAE6OF02F15IL.9.12.B01.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
tcagtgatacgtctcacgaccggtgctcgatttagtagtgtagattccgggcgggcagcaagactggtgttgcagacccaggtcttcatttctcgtcgttgctctggatctcgtggtcgccgtacggggacatcgtgatcgacccagtctccagactccctggctgtgtctctgggcgaggacgggcccaccactcaactgcaagtccagccagagtgtttanacgctaccgacaacaagtactaccgttagcgttggtatcagcaanaaaccaggacacgcctacctaaactnctacattaacgtggcactacctacccggcaacgtccgggtccctcgggggggacctacgttactacgtacggtacgtacggtacgggtccggtacgggtacgtaacggtactttaccgtaactccgttacgacctactacgacggacacgtaccttcgactacggtacgtacggaacgtagtacggtcgtacgttacgtttacttacctgttaactacgttacgtttaccgtcgggtacgttacggtaccgtaacgggtaccgtaacggtaacggtaacgtacgtaaacgtaacgtacggtacggtacgtacgacgtaccgtacggtacgtacgtacgttaccgtacgttacccgttccgtacctacgtacgtacgtacgacttaacg

SEQ ID NO: 16888 - DNA, 516 bp, Homo sapiens
  misc_feature: GYAE6OF02IQE6Y.9.12.B01.1.454.CMB.1.raw
  modified_base (211)..(211): a, c, t, g, unknown or other
  misc_feature (211)..(211): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggccgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagntgtggcagtttatactgtcaactgttttcncgggtcgttcggaccaagggaccaaggtggaaatacgaaacgaactgtggctgaccacatcgtgtccttcacttccttcccgctactctagaagtacgtatcg

SEQ ID NO: 16889 - DNA, 525 bp, Homo sapiens
  misc_feature: GYAE6OF02HGWNT.9.12.B01.1.454.CMB.1.raw
  modified_base (236)..(236): a, c, t, g, unknown or other
  misc_feature (236)..(236): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttttanacggctccgacaacaagaactactagcttggtatcagcagaaaccaggacagcctacctaaactgctcattaactgggcatctacccggcaactccgggtcctgaccgattcagtggcagcggtctgggacaggtattcgactctccaccatcagcacgctgcaggctgaagatgngtctagtttatactgtacaactagtttctcgggtcgttcggccaagggaccgaaggtcgaaagtacgaaaccgtaacgtcggtacggcgtagacacctgtctcgttctctacg

SEQ ID NO: 16890 - DNA, 586 bp, Homo sapiens
  misc_feature: GYAE6OF02HXHGY.9.12.B01.1.454.CMB.1.raw
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctaccgacaacaaagaactacttagcttggtatcagcaagaaaaccaggacagcctcctaaaactgctctaattaactggggcacttccgtaccccggcaagttccccggggtcccctgacccgattcagtggcaggcgggtcngggacagtatttcactcncaccngtcagcagcctgcaggctaggaagacttggtggtctaggtttttactactgttactaacgttacggttttcgcgggtccgtttaccggcgaaacgggaccgtaagggagtaaacgacgaaacgtacgtgtgggtactgacacctatcttagttcttactaccttccgtaccctccgacttcctaacggtaacggtacttaacg

SEQ ID NO: 16891 - DNA, 570 bp, Homo sapiens
  misc_feature: GYAE6OF02F2Q8H.9.12.B01.1.454.CMB.1.raw
  modified_base (363)..(363): a, c, t, g, unknown or other
  misc_feature (363)..(363): n is a, c, g, or t
  modified_base (501)..(501): a, c, t, g, unknown or other
  misc_feature (501)..(501): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaagtccggggtccctgaccgattcagtggcaggcggtcgtgggacagatttcacgtctcacntcagcagcctgacgaggctagaacgatgtcggactagtttaactacttcgtactaacgttgtttccgtacgggtcgttccggaccggaaggaaccgtaggtaacgtaaagtactaaagtacgtaaacgtgtgggtacnggtaccaccgtatacttcgtcctttanaacctttccttccccgacttactacgttacggtacgtaacgg

SEQ ID NO: 16892 - DNA, 679 bp, Homo sapiens
  misc_feature: GYAE6OF02HI1G3.9.12.B01.1.454.CMB.1.raw
  modified_base (213)..(213): a, c, t, g, unknown or other
  misc_feature (213)..(213): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctccagactccctggctgtgtctcgtgggcgagacgggccaccatcaactgcaagtccagccagagttgttttanacggctccgacaacaagaactacttagcttggtatcagcagaaaccaggacagccctacctaaactgctacaattaacgtgggacattcctaccccggcaacgttccccggggtcctacgaccgtattacgagtggcacggcgggtcgtgggacagtacttcgactctacacctatacacgacacgccgtgccgaggcctagaacgacgtggtacggcgttaagtttacttacgtacgttaaccgtaacgtttacgttttcggtaccggggttccgtttaccgggacccggtaaacgggtaaccgtaaggggtacggttaaacgtaaccgtaaaaccgtacgtaggtcggtacgtacgaccgtactaccgttacgttcggttaacctttacccgtaacgtttccccgttacccccggtaccttaacccgttaccggtttaacggtaaccgtaccggtttaaacccg

SEQ ID NO: 16893 - DNA, 591 bp, Homo sapiens
  misc_feature: GYAE6OF02HL5LY.9.12.B01.1.454.CMB.1.raw
  modified_base (312)..(312): a, c, t, g, unknown or other
  misc_feature (312)..(312): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctacctaaactgctcattaacgngggcatctacccggcaacgtcccggggtcctcgaccgattcagtggacaggcgggtctggggacagtatttcactctaccaccatcagcagcctgcaggcagaagatgtggcttagtttacttacgtcgtactaacctgttttccgtacggggttccgttccgggaccgaaacgggtaccgtaaggtacggtaaactaccggtaaaaccgtaacggtacgggttacggtaccgtaggaccctaaccgtacgttaccttacggttccttaccgtaacccg

SEQ ID NO: 16894 - DNA, 542 bp, Homo sapiens
  misc_feature: GYAE6OF02HU9HS.9.12.B01.1.454.CMB.1.raw
  modified_base (385)..(385): a, c, t, g, unknown or other
  misc_feature (385)..(385): n is a, c, g, or t
  modified_base (488)..(488): a, c, t, g, unknown or other
  misc_feature (488)..(488): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggacagcctacctaaactgctcaattaaactgggacattccgtacccggcaacgttcccggggtccctgaccgattcgagtggcaggcggtctgggacagtatttcactctcacatcagcagctgngagctagagatgtgctagtttattactgtactaactagttttcgcgggtcgtcggtacgaacgggtaaccgtaaggtagaacgtacgaaacgaacgtgtcggntgctacctacgtctagtcttacacttcctccgtcctagtcctagtacgacgtac

SEQ ID NO: 16895 - DNA, 547 bp, Homo sapiens
  misc_feature: GYAE6OF02HTN3N.9.12.B01.1.454.CMB.1.raw
  modified_base (226)..(226): a, c, t, g, unknown or other
  misc_feature (226)..(226): n is a, c, g, or t
  modified_base (395)..(395): a, c, t, g, unknown or other
  misc_feature (395)..(395): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaaanaagaactacttagcttggtatcagcagaaaccaggacagcctacctaaaactgctacattaacgtggcatcgtacccggcaacgtccgggtccctgaccgattcagtcgcgagcggtctgggacaggtatttcactctcacctatcagcagcctgcaggctagaacgtntgtgactagtttatactgtactaacgtagttttcgtcgggtccgtcggacgaacgggtaactaacgggtagaaactaccgaaacgtaacgtgtaggctacgcacctatctgtctactactccttccgtccctagtccgtagacgtacgtacg

SEQ ID NO: 16896 - DNA, 636 bp, Homo sapiens
  misc_feature: GYAE6OF02FYY7O.9.12.B01.1.454.CMB.1.raw
  modified_base (212)..(212): a, c, t, g, unknown or other
  misc_feature (212)..(212): n is a, c, g, or t
  modified_base (407)..(407): a, c, t, g, unknown or other
  misc_feature (407)..(407): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctccgacaacaagaactacttagcttggtatcagcaagaaaccaggacacgaccctacctaaactgctactattaacgtgggaccagtccgtaccccggaccaacggtccccgggggtacccctacggacccgtatttaccgaggtcggacgaggccggggtcgtaggggactagtacgtttccacgttcnccaccatcagcacgtcctgcgaggctagaagtagtgtggacttaggttttattacgtacgttactaacgttcgttttccggcgggttccggttaccgggtacccggaaacgggtaaccgaaggtaaggaaacgttaaccgaaaccgtacgtaggtcggacgtacgaccactacgttctcgttaccttcgtacttcccgttacccgcttactacgtacgtacgcttaacg

SEQ ID NO: 16897 - DNA, 672 bp, Homo sapiens
  misc_feature: GYAE6OF02H8BP5.9.12.B01.1.454.CMB.1.raw
  modified_base (211)..(211): a, c, t, g, unknown or other
  misc_feature (211)..(211): n is a, c, g, or t
  modified_base (407)..(407): a, c, t, g, unknown or other
  misc_feature (407)..(407): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgaggagggccaccatcaactgacaagtcagccagagtgtttanacgctcgacaaacaagaactacttagcttggtactcagacaagaaaccgaggacacgcctacctaaacgtgacctactaattaaacgtgggacctacgtacccgtacccgggactaaacggttccccggggtaccctacggaccgtattcgaagtcggacgacggtcgggtcgtgggacagtacttcacttcaccnctatcgacgcacgcctagcgaggtctacggaagtatgggtcgtacttaagttttaactagttacgtaactaacgtttcgtttcggtacgggtcgttaccggacggtaacgggaaccgtacgggttaagaaacgttaacgaaaccgttacggtacggtacggtacgtacggaccctaacgtaccgtacgttacgttacctttaccgttacctttccccgtttacccggacctaccttaccggtaacggtacggtaccgtttaaccg

SEQ ID NO: 16898 - DNA, 603 bp, Homo sapiens
  misc_feature: GYAE6OF02IQOJ6.9.12.B01.1.454.CMB.1.raw
  modified_base (212)..(212): a, c, t, g, unknown or other
  misc_feature (212)..(212): n is a, c, g, or t
  modified_base (399)..(399): a, c, t, g, unknown or other
  misc_feature (399)..(399): n is a, c, g, or t
  modified_base (433)..(433): a, c, t, g, unknown or other
  misc_feature (433)..(433): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggcctccgacaacaagaactacttagcttggtatcagcaagaaaccaggacagcctcctaaactgctcattaacgtgggcatcctacccggcaacgtcccggggtcccctaggacccgtattcaggtcggcacggcgggtcgtgggacaggtatttccgacttctcaccatcagccagcctgcgnggctagaagtgtggtggcttaggtttattacgtntctaacttacggtttcgtcgggtcgttccggcgtaacgggaccgtaaggtacggaactaaccgaaacgacggttagtcggtactcgacctacctagttcgttcgttaccttaccgttacgttccgttaccccgtaccgttacgtaccttaacggaaccggtcgttaaccg

SEQ ID NO: 16899 - DNA, 726 bp, Homo sapiens
  misc_feature: GYAE6OF02HZZEY.9.12.B01.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
  modified_base (459)..(459): a, c, t, g, unknown or other
  misc_feature (459)..(459): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgccgtacgggacatcgtgatcgacccagtctccagactccctggctgtgtctcgtgggcgagacggccaccatccaatgacaagtccagccagagtgttttanacggctccganaacaagacttactagcttaggtatcagcaagaaacaggacacgacctactaaaactgaccttntaacttaacgcggctaacttccgtaacccggactaaacggtcccggggtcctacgaacccggtatttaccgaggttaccggacgtaacgggccgggttaccgtaggggaacctaacgggttacttttaccaaccggttcccgttaanaaccccgtagttaccaaacggtcaaccgggaacccttgacccggtaagggaccttaacgggaaaaggttaccggttggttaacgggtaccttaaaggttttaacccttaaagtcggttaacctaaacgttcggtttttcgacgggtcgtttaccggaccgtaaacggggacctaagggggtactaaaaccgtcgtaaaacggtaacttgggaacgtccgtcgtaacccgaccgtaaagttccttaggttaccccttattaaccccgg

SEQ ID NO: 16900 - DNA, 746 bp, Homo sapiens
  misc_feature: GYAE6OF02HSFRA.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatcgacccagtctccagactcctggctgtgtctctgggcgagacggccacatcaactgcaacgtccacgcagagttgttttacacggctaccgaacaacaaagtaactactaagcgttaggtatcgagacagaaaccaggacacgacctacctaaacgtgacctcaattaacgtaggactacgtcgtaaccccggactaaacgtccccgggtacctacgaccggtattccgagtcggacgtacgtcgggtacgtacggactaacggtctttacaccgttcctacaacctaactaccgacgtaccgaacgtccgtacgacggtaacggcttaaggaaacggttattcgggtacgggtaccgttaaagttttaaccgttaccggttacgttaaaccgtaaccgtttaacgggtttttccggaccgggggttaccgtttacccgggaaacggttaaacccgggggaaacccgtaaaggggttaacgggtaaaacctaaccggtaaaacccggttaaccggttagggtaaccccggttagaccccggtaacgtaaccctaccggttacctttacggttacccttaccggttaaccg

SEQ ID NO: 16901 - DNA, 517 bp, Homo sapiens
  misc_feature: GYAE6OF02GPO96.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctaccggcaatccggggtcctgaccgattcagtggcagcggtctgggacagatttcactctcaccatcagcagcctgcaggctgaagatgtgctagtttatactgtcaactagttttcgtcggtcgttcggcgaacggacaaggtagaaatacgaaacgaactgtgctgacgaccatctcgttctctacttaccgttcccgacctacgtctagtaacgtagtaac

SEQ ID NO: 16902 - DNA, 591 bp, Homo sapiens
  misc_feature: GYAE6OF02JFFJM.9.12.B01.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (544)..(544): a, c, t, g, unknown or other
  misc_feature (544)..(544): n is a, c, g, or t
  modified_base (574)..(574): a, c, t, g, unknown or other
  misc_feature (574)..(574): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccagagtntttancggctccganaacagaactattancttggatcagcaagaaccngacngtcctcctaaatgctcagttaacctggctatcacccggntaacgtcccgggtcctgaccgtattcgagtgcagccggttanacgggactagactttcacttcncaccatccaaggcacgcctagaccgtaggacctagaaagtntacggtggaccttaggttttactacgttgttaccgtaaacttgtttttccgcgggtaccgtttccggaccgaacggggtaaccctaagggttaacggtaactacgtaaaccgagtttacgaggccttaagccaccgtatccggtnttctacctattcccgtccgttacacgttanaccgtaggtacttaccg

SEQ ID NO: 16903 - DNA, 690 bp, Homo sapiens
  misc_feature: GYAE6OF02G5EJC.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggaccagcctacctaaactgactctaattaacgtgggacatccgtaccccggactaacgtcccggggtccctggtaccgacttcgagtggcaggtcggggtcgtcggggacagtactttacgactctacacctatcagcacgcctgcaggctagaagtagtggtacggtacgttacggttttaattaccgtaggttacctaaacgtttaccggttttccggtacggggttccggttacccggggacccgtaaaacgggggtaacccgtaaacggggttaacggtaaaacgttaaccggaaaaccgttaaccggtacggtacgggttaccgtacggaccctaaccgtacgttccgttaccgttacgtttaccgtaccgtttcccgttacccgtacccgtacttaccggtaacggtaaccgttaggtaacccg

SEQ ID NO: 16904 - DNA, 592 bp, Homo sapiens
  misc_feature: GYAE6OF02IDG1S.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaaacaagaactacttagcttggtatcagcaagaaaccaggacagcctcctaaactgctcattaactgggcatcctacccggcaacgtccggggtccctgaccgtattcagtggcaggcgggtctgggactagatttcactctcaccatcagcagccctgcacggctaggaacgagtggtggacttaagttttacttacgttgttactaacgtagttttccgtcgggtaccgttcggaccgaacgggtaaccgtaaggtacggaaactacgaaacgtaacgtggtacggactagcctaacgacgttcgttacttaccgttacgtaccttcccgttaccccgtactacgttctaacggaacgtacgtaaccg

SEQ ID NO: 16905 - DNA, 599 bp, Homo sapiens
  misc_feature: GYAE6OF02FGTE6.9.12.B01.1.454.CMB.1.raw
  modified_base (211)..(211): a, c, t, g, unknown or other
  misc_feature (211)..(211): n is a, c, g, or t
  modified_base (428)..(428): a, c, t, g, unknown or other
  misc_feature (428)..(428): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacagactactagcttggtatcagcaagaaccaggacagcctacctaaactgactcattaactgggcatcctaccggcaacgtccggggttcctgaccgatttccgagttcggcagggtccggtcgtgggacagtactttcacgtctcacatcagccagccctgcaggcctagaagtagtggtcggtacttaaggtttactacgtntacaacgttcggtttccgtcgggtcggttaccggaccgaaacgggaccgaagggtaagaaacgtacgaaacgtaatacggtgtacgtacacgacctacgtcttacgttaccttacctaccgtttaccctacccgaccgttaacgttccgtaacggtacgtacgttaacccg

SEQ ID NO: 16906 - DNA, 908 bp, Homo sapiens
  misc_feature: GYAE6OF02I1ACN.9.12.B01.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcggtgatgacccagtctcagactccctggctgtgtctcgtgggacgagacgggccaccatcgaactgcaaggtccagccagtagttgtttagcggctccganaacaagactacgttgacttggtatcagacaacgaaacccgaggaacctacggacccttaccgtaaaaccgttcggaccttacgtaaactttaaacccggnggggtacctaacgtttaccccggaaaccccggtaccgtaaaccggttccccgggggttaccctacggtaacccgtaattttacccgaagggttacgaccgaacggggtccgggttccgttacggggaaactacgggttaacttttaccggacctttaccggttaccaaaccgacgtttaccgaagtcccgaacgtccgttacggacgtacggtcgtaacggtaacggtacggtcggttacggttacgttaacggttttaaccgttaccgtaagtttaccgtaaaacggttttcccggttttacgggtaacccggggttccggttaaccgggtaacccggtaaaccggggttaaaccgggtaccggggtttaaaacgggttaaccgtaaacccggtaaaacccgggttaaacggttaccgggttaaccgtaacgggttacccgtacccggttaaaccgtaccggttttacggtaacccggttttacccgtttaaccggttaaccccgttttccccggttaaccggttaaccggtttaccgttaaacgggttaaccggtttaccggttaacccgtttaccggg

SEQ ID NO: 16907 - DNA, 527 bp, Homo sapiens
  misc_feature: GYAE6OF02FLTB5.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaagtccggggtccctgaccgattcgagtggcagcggtctgggacagtattcactctcacatcagcagcctgcaggctagaagatgtgctagtttatactgtactaactagttttctcgggtcgttcggacgaagggacgtaaggtaggaaatacgaaacgacgtgtagctgacacacgtctgtcttctactccgttcccgcctataccgtagtaacgtacttaacg

SEQ ID NO: 16908 - DNA, 656 bp, Homo sapiens
  misc_feature: GYAE6OF02H34W4.9.12.B01.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggcccaccatcaactgcaacgtccagccagagttntttttacacggcctaccgacaanaaacgaacttacgttagcttggtatcagcaagtaaaccaggacagcctacctaaactgctcaattactggcatctacccggnaacgtccgggtcctgaccattnaggtgcaggcgtntgggactagtacttcactctcacctatcagcacgcctacgcaggtctagaagacttggtacggtaccgtttaagtttaactttaacgtcgttaaccgttaaacttacggtttttaccggtaccggggttaccgtttaccggggtaaccggtaaaccggggttaaacccgtaagggggttaacggtaaaaaccgtaccggtaaaaacggtaacctttaagggtaccggtacgttaccggaaccttaccgtaaacgttccggtaacgtttcccgttaacctaccg

SEQ ID NO: 16909 - DNA, 627 bp, Homo sapiens
  misc_feature: GYAE6OF02IA4EK.9.12.B01.1.454.CMB.1.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (463)..(463): a, c, t, g, unknown or other
  misc_feature (463)..(463): n is a, c, g, or t
  modified_base (606)..(606): a, c, t, g, unknown or other
  misc_feature (606)..(606): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatcgacccagtcctccagacctccctggctgtgtctcgtgggcgaggacgggccacctatcaactgacaagtccagccagtagttgttttagacggtcnccgaacaaacaacgtaactacttagcttggtatcagcaagaaaccaggaacacgtacctcctaaaactnactacaacgttaacngggacatccgtaccgcaagtcccgggtcctcggaccattccgagttggcaggcgggtctagggacagtactttcacttcncaccgntacatcgacgctgctaggctagagatgtagcttagtatactgtaacctaatcggtttcgcgggtnttccggacgtaacgggaacccgaaggtaacgaaacgttaacgaaacggtaaaccgtggtacgggtactcgacgtaacccgtattaacctcggttcccttacgaacgtttcccccttcccggaccctacgtttaaccccgttanaaccggggttaacttaaccgg

SEQ ID NO: 16910 - DNA, 681 bp, Homo sapiens
  misc_feature: GYAE6OF02I0V5G.9.12.B01.1.454.CMB.1.raw
  modified_base (286)..(286): a, c, t, g, unknown or other
  misc_feature (286)..(286): n is a, c, g, or t
  modified_base (433)..(433): a, c, t, g, unknown or other
  misc_feature (433)..(433): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctcccgtggctgtgtctctgggcgagaggccacatcaactgcaacgtccagccagagttgtttactacggctaccgaacaaacaagaacttacttagcttaggatcagacaagaaaccaggacagacctaccgtaaacngtactactaattaacgtgggacacgttaccgtaacccggactaacggtccccggggtaccctacggaacccgtattaccgaggtacggaccgtacgggtcgggtcgtaggggaacctaggtactttaccgaacttccacgaacctanaccgtaacgacctacggtacctcgacgaggtaccgtaagaaacgtgtagtacggtacttaagtttactacgtcggtactaacgttggtttaccgcgggtacgttaccggacgaaacgggtaaccgtaaggtaacgggtaaacttaacggaacgtaacggtcgtacgacgttacgactaaccgtacttcgtacgttaccgttcttaacgtcccgtttaccgacttaacgtcgtaacgtaacgacttacg

SEQ ID NO: 16911 - DNA, 703 bp, Homo sapiens
  misc_feature: GYAE6OF02I2D1Y.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacggggacatcgtgatgacccagtctccagacctccctggctgtgtctcgtgggcgagagggcccaccatcaactgcaagtccagccagagttgttttactacggctaccgacaaacaagaactacttagcttggtatcagacaacgaaaccgaggacacgcctacctaaactgctactattaacgtgggcactccgtacccggcaacgtccggggtccctgacctagttcgaggtcggcgaggcgggttctgggacagtactttcactcctaccactataccgacgaccgacgccgtcggtaccgaagggtcgtaaggaaagtcggtaggtacggtacgtttagttttaacgttacttaggttaaccttaaccgtttacggtttttccggtacggggttcccggttaccgggaccggtaaagggtaacccggtaaagggttacgaaaaccgtaccgtaaaaccgtaacggttaccggttacggacgtcgacccgtacctaacgttcgtttaccggttaccctttcgttaacccgtttcccgtttccccgactttaaccggaccgtaacggtacgttaccgtaaccg

SEQ ID NO: 16912 - DNA, 650 bp, Homo sapiens
  misc_feature: GYAE6OF02HMG0O.9.12.B01.1.454.CMB.1.raw
  modified_base (295)..(295): a, c, t, g, unknown or other
  misc_feature (295)..(295): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctgctgtgtctctgggcgagagggccaccatcaactgcaagtccagccagagttgttttatacggctccgaacaacaagtaactacttagcttggtatcagcaagaaaccaggacacgcctacctaaactgctctaacttaacgngggcatccgtacccggacaacgtcccggggtaccctgaccgtattcagtggcaggcgggtctgggacagtactttcactcacaccatcagacacgcctgcgaggctagaacgtatggtacggtacttagtttactttacgtacgtaacgtaacttacggttttccgacgggttccgttaccgggaccgtaaaccggggtaaccgtaagggtaacggtaaacgtaaccgtaaacgtaaccggtacggtacggtacgttcgaccgtaccgtaacttcggttacttaccgtttacctaaccgtttcccgttaccccgttacctaccgttaccggttacgtaaccggttacgttaaccg

SEQ ID NO: 16913 - DNA, 598 bp, Homo sapiens
  misc_feature: GYAE6OF02IMVDX.9.12.B01.1.454.CMB.1.raw
  modified_base (236)..(236): a, c, t, g, unknown or other
  misc_feature (236)..(236): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttanacggctccgacaacaagaactacttagcttggtatcagcaagaaaccaggacacgcctacctaaatcgctcattaacgnggacactcgtaccgnacgtccgggcctgacatcagtcgcgnggcggtcngggacagtctttacactctacaccanacagcacgtctacgcgacggcganaagagtgtcgggtacttagttttagtacgttgtacttacgttacgtttcggtcgggttacggttccggaccggtaaacgggaaccgttaacggggtagtaaaacgtaaccgtaaaacggtaacgtcgggtaacgtacgtcgtaacccgtaacgtaccttacggtacgtttccttagttaccccg

SEQ ID NO: 16914 - DNA, 652 bp, Homo sapiens
  misc_feature: GYAE6OF02G49DL.9.12.B01.1.454.CMB.1.raw
  modified_base (224)..(224): a, c, t, g, unknown or other
  misc_feature (224)..(224): n is a, c, g, or t
tcagtgatacgtctcacgaccggtgctcgatttagtagtgtagattccgcggggcagcaagatggtgttgccagacccaggtcttcatttctctgttgcgtctggatctctggtcgcctacggggacatcgtgatgaccctagtctccagtactccctggctgtgtctcctgggcgaggacgggccaccatcgaactcgacaagtccagccagacgttgtttanacggctccgacaacaagaacttactagcttaggtatcagcagaaaccaggacagccctaccgtaaactcgcctactaacttaactgggtacagtaccgtaaccccggactaacgtccccggggtcctggtacccgattcgaggttcggaccaggtccgggtctaggggacagtactttcactctcacctactaccagtcacgtcctaggacgaggctaggaagtagtggtgacgttagtttacttacgtgttactaacttagttttccgtcgggtaccgttcggaccgtaagggtaccgtaagggtacggtaaacgtacggaaacgtacgtagacggtacgtaccgctaaccgtacgtcgtacggtttcctacgttaccgttccccgttacccgtacctacttaccgtacggtaccgtaccgttaccg

SEQ ID NO: 16915 - DNA, 714 bp, Homo sapiens
  misc_feature: GYAE6OF02IM6QC.9.12.B01.1.454.CMB.1.raw
  modified_base (382)..(382): a, c, t, g, unknown or other
  misc_feature (382)..(382): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagtagttgttttataccggctacccgaacaaacaaacgtaacctacttagtcttaggtatacgagacaagaaaccgaggacagcctacctaaactgctacattaactgggacactaccgtacccggactaaccgttcccggggtccctacgaccgtattcgagtcggcacggcggtacgngggactagtacttacacgttcacacacacgagacgacgtccctggaccgtaggtacgtaagtaacgtacgttggttacgcgtttaagtttacgttacgttacgttactaaacgtttcggtttttaccgggtaccggttcggtaccggacgggtaaaccggtaacggtaacggggttaaacgtaaacgtaaccggtaaaacgttacggttacggtaacggtcccgtacgacccgtaacctcggtttacgttaccgtttaccgttaccgttaccgttaaccccgttcccggtaaccttacgttacccggtaacgttaaccggtagttaacccgg

SEQ ID NO: 16916 - DNA, 670 bp, Homo sapiens
  misc_feature: GYAE6OF02I1QEW.9.12.B01.1.454.CMB.1.raw
  modified_base (216)..(216): a, c, t, g, unknown or other
  misc_feature (216)..(216): n is a, c, g, or t
  modified_base (296)..(296): a, c, t, g, unknown or other
  misc_feature (296)..(296): n is a, c, g, or t
tcagtgatacgtctcacgaccggtgctcgatttagtagtgtagattccgcgggcagcaagatggtgttgcagacccaggtcttcatttctctgttgctctggatctctggtcgcctacggggacactcgtgatgacccagtctccagactcccgtggctgtgtctcgtgggcgagagggccaccatcaactgcaagtccagccagagttgttttanacggctccgacaaacaagactacttagcttggtatcagcaagaaaccaggacagcctacctaaactgctctaattaacgngggacactccgtacccggactaacggtccggggtacctgaaccgtattcgagtcggcgaggtccggtactggggactaggtactttccgaacttctacaacctaatcgaacgtgaccgtctcgacgacggtctaggaaacgtgttggtacgtacgttagtttaacgttacgtcgtaacttaagttcgttttcgccgggttcgttaccgggaccgtaaacgggaacgtaacggtaacggtaacgtaaccgtaaacggttaactacgggtaggtaccgttcgaccgttacgtaacgttcgttacgttaccttaccgtaaccgtttacccgttccgtaccgttaaccttcgggtaactaacggtaccgtttaaccgg

SEQ ID NO: 16917 - DNA, 852 bp, Homo sapiens
  misc_feature: GYAE6OF02F5X5C.9.12.B01.1.454.CMB.1.raw
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
tcagtgatacgtctcacgaccggtgctcgatttagtagtgtagatttcggtcggggggggtctcaggagggcaagcgccctctcccaggaacgttccaccgacctactggtcccgtgggctcctgcctcctcctacacccctcgtcacctccacggcacgagggttccgtggcccagtctggtccctgtactcagtcctacccgtccgcgtccggtctcctggacagtcggtcaccgatccgtccgggtncgtacctggacccaggctaccgtgactnttcggtcgtcttanaacctgtcgttcctccgtaggttacccaacctcgcctaacccgacgggccaaacgtcccccaaacgttccgactcggtactttacncggtaggtacaaacggtacgtccgggtacccgttcggtcggggttccccgtgtaacgtttccggttcctttaccgtcgtcgggtaacccgttaccgtaaggtttccgaacggtaacccaaaccggtacccggtaccccgttccccgttccgggtaaacccggtttcccggtacccgttcggggtaccccttacccggaaacggttccccgtaacggtaacccggtaagtaccgggaaacgggttccctaaggtaaacctttaccgttaacgtcgttacctacggtcctaacgtaacggtaacgtccgaacggtaccggtaaccctaaacccggttaagtaacggtccgttaccggttacgggttaacggtacccggttacccgacggtacccgtaaccgggtccggttaacgtacccgaccgtacccggtaaccgacccctaaccccgtacgtaccgttacctaccttacccgg

SEQ ID NO: 16918 - DNA, 683 bp, Homo sapiens
  misc_feature: GYAE6OF02H6U0G.9.12.B01.1.454.CMB.1.raw
  modified_base (213)..(213): a, c, t, g, unknown or other
  misc_feature (213)..(213): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttanaccggctccgaacaacaaagaactacttagcttggtatcagcaagaaaccaggaccagcctacctaaactgacctacaacttaactgggacctattaccgtaaccccgggactaacggtccccggggtcccctagaaccgtattcgaggtcggcacggcggggtcaggggacagtatttccactcctacaccagtcagacagtcctgacaggtctaggaagtactggtggacttaagttttattacgtcgttaacgtaactttacggttttccggtacggggtaccgtttccgggaccggtaaacggggtaaccgaaaggggttacggaaaacgttaacccgaaaacggtaacgttagggtacggtacctacgtaccgaccttacgttccgtaccgtttactttacccgtactttcccgtttaccccgaccgttaaccgttaaccgtaacggtaaacgtccgttaaaccg

SEQ ID NO: 16919 - DNA, 694 bp, Homo sapiens
  misc_feature: GYAE6OF02I43IK.9.12.B01.1.454.CMB.1.raw
  modified_base (211)..(211): a, c, t, g, unknown or other
  misc_feature (211)..(211): n is a, c, g, or t
  modified_base (443)..(443): a, c, t, g, unknown or other
  misc_feature (443)..(443): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcgttggtatcagcaagaaaccaggacacgcctaccgtaaactcgctactacttaacgtgggacaacttccgtaaccccggaccgaacgttccccggggggtacccctacggaaccccggtattaccgagggttcggacacgggtccgggtaccgtggggaactagtacgtttacaccttcgtacgaccctataccacgtacgacnccggtgaccgaggtcctaagggaacgagttggttcggaccgttaacggttttattaacgtcgttaactaacgtttaggttttcccgtacgggtcgttaccgggacccgtaagggaaccgtaagggtacggtaaactacgaaacgttaacggtggtcgacgtacgtaccgactacgtcccgttaccgttacgttacctacttcccggttacccctacgttacctcggtaaccggtaacgtaccgtttaaccg

SEQ ID NO: 16920 - DNA, 537 bp, Homo sapiens
  misc_feature: GYAE6OF02I3TJL.9.12.B01.1.454.CMB.1.raw
  modified_base (210)..(210): a, c, t, g, unknown or other
  misc_feature (210)..(210): n is a, c, g, or t
  modified_base (374)..(374): a, c, t, g, unknown or other
  misc_feature (374)..(374): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacagaactacttagcttggtatcagcagaaaccaggacagcctactaactgctcatactggcatctaccgcaatccgggtcctgaccgatcagtggcagcggtctggacagctttacgactctcacactcagcacgcctgcgagctagaagnttgtcggctagtttatctgttacaacttgtttacgtcggtcgtcggtaccgaaggaccgtaaggtagaaacgtacgaaacgtaacgtgtacggctcgtaccacacgttctacggttcttacctcttaccgttcccgcctactactacgtaggtaccgttaacg

SEQ ID NO: 16921 - DNA, 551 bp, Homo sapiens
  misc_feature: GYAE6OF02ILCW0.9.12.B01.1.454.CMB.1.raw
  modified_base (212)..(212): a, c, t, g, unknown or other
  misc_feature (212)..(212): n is a, c, g, or t
  modified_base (399)..(399): a, c, t, g, unknown or other
  misc_feature (399)..(399): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacggctccgacaaacaagaactacttagcttggtatcagcaagaaaccaggacagcctacctaaactgctacattaactgggcatcctacccggcaacgtccggggtccctgaccgattcagtggcacggcgggtctggggacaggtactttcactctcaccatcagcacgcctgcacggctgaagngtgtggctagtttattactgtcaacttgttttccgcggtcgttcggaccgaagggacaaggtagaaactacgaaacgtaacgtagtcgactcgacacctagtcttgttccttcacttcccttcccgacctacgttcctaggtacgagttacg

SEQ ID NO: 16922 - DNA, 553 bp, Homo sapiens
  misc_feature: GYAE6OF02HFUO2.9.12.B01.1.454.CMB.1.raw
  modified_base (344)..(344): a, c, t, g, unknown or other
  misc_feature (344)..(344): n is a, c, g, or t
  modified_base (472)..(472): a, c, t, g, unknown or other
  misc_feature (472)..(472): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctcgacaacaagaactacttagcttggtatcagcagaaaccaggacagcctacctaaactgctcattaacgtgggcatcctaccggcaacgtccggggtccctgaccgattcagtggcaggtcggtcgngggacagtatttcactctcaccatcagctacgcctgacgaggctaggaactagtcggtggacttagtttaattactgttacctaacgttcgtttcgcgggtcgtcggacgacgggaacgaggtagaanacgtaacgtactggtgctagcacgtatcgtcgtacttcctacttcccgttacccgactactcgtacgtaacgtacgtaacc

SEQ ID NO: 16923 - DNA, 861 bp, Homo sapiens
  misc_feature: GYAE6OF02G16L5.9.12.B01.1.454.CMB.1.raw
  modified_base (220)..(220): a, c, t, g, unknown or other
  misc_feature (220)..(220): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagactccctggctgtgtctcgtgggcgaggacgggcccaccgatcaactgacaagtccagccagtagttgtttanacggtctaccgaacaacgaaacgaacttacgttagtcgtttaggtatcagacgaaacgaaaaccgaggaacacgtacccttaacctaaactcgaccttacaacgtttaaccgtgggacctacgttacccgttaaccccggaacgtaaccggttccccggggttaccctacggaaccccgtaatttcggacggttcggacggtacgggtccggggttacgtacggggtaaccgtaaggttactttttaccgaaccccgtttctaccccgtaacccgtaatttaccccgagtacccggtacggtcccttggaaccgtacggccgttaagggaaaccgtaggttcgggtacggtacttaacggttttacgttttaccgttacggtaacctttaaacgtttaccggggtttttaccgccgggggtttacccgtaccggggttaacccgtaaacggggtaaacccggtaaaggggttaaccggtaaaccgttaaaccggtaaaaccggtaccgttacgggttaccgtaccgttaccgaccgtaccgttaaccgttccggtttaccttaccgttaccgttaccggtttaccccctacccggtaccgttaaccttaaccgggttacgtaaccggttacccgttaaccg

SEQ ID NO: 16924 - DNA, 749 bp, Homo sapiens
  misc_feature: GYAE6OF02HMBPD.9.12.B01.1.454.CMB.1.raw
  modified_base (215)..(215): a, c, t, g, unknown or other
  misc_feature (215)..(215): n is a, c, g, or t
  modified_base (664)..(664): a, c, t, g, unknown or other
  misc_feature (664)..(664): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagtagttgtttanacggctaccgaacaacaacgaactacttagcttggtatcagcaagaaaccaggaccagccctacctaaactgacctacaacgttaacgtgggactacgttcccgtaccccgggacgtaaccggttccccggggtccctacggacccgtacttacgacggtcggacgtacggtcggggtacgtacgggactaagtactttcaccgtcgtaccaacctagtaccacggacctacggcccttagggaccgtaacggggtacctaagggtaaacgtaggttacggttcggtaacgtttaaacgttttacgttaaccggttacgttaacgttaaccgtttacggtttttcccggacggggttaccgttaccgggaaccggtaaaccggggaaccggttaagggtaaacggtaaccgtaaacgtaaccggttaaggttccggtaaggtcccgtanacccggtactttacgtcggttacgttacttacctaccgttcccgttacccgtactaccgttacggtaacgaccggttacgtaccg

SEQ ID NO: 16925 - DNA, 529 bp, Homo sapiens
  misc_feature: GYAE6OF02FFQF3.9.12.B01.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (491)..(491): a, c, t, g, unknown or other
  misc_feature (491)..(491): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagngtgttttanacggctccgacaacagaactacttagcttggtatcagcagaaccaggacagtcctcctaaactgctcattaactgggcatcctacccggnaacgtccggggtcctcgaccgtattcagtggcagggcggtctagggacagtatttccacttctcaaccatcagccagcctagcaggctgaagagttgtgtcttagtttactacttcgtacacttagtttcgacgggtcgtcggacgacggacgaggtagaatacaaacgtctaggtgctgcacctagtctnttcctactcttcctcccgctactgtacgacgtacgtac

SEQ ID NO: 16926 - DNA, 852 bp, Homo sapiens
  misc_feature: GYAE6OF02F9W44.9.12.B01.1.454.CMB.1.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagtgatacgtctcacgaccggtgctcgatttagtagtgtagattccgcgggcgagcaagatggtgttgcagacccaggtcttcatttctctgttgctctggatctctggtgcctacggggacatcgtgatgacccagtctccagactcccgtggctgtcgtctcgtgggcgagagggccaccagtcaactgacagtccagccagagttgtttacacggctaccgacaacaacgaactacttagcttaggtacncagcaagaaccaggacagcctactaactcgctcattaacgnggcacgtccgtacccggctaacggtcccggggtacctacggaccgactttcgacgtcggaccgacgggtccggggtacgtggggaactacgggtactttaccgacgttccctacgaaccctaagttacccgaacggtacccgtaacgggtccctacggtaccggtaacgggtacctaacgggtaaacggtacggttacgggttaccggtacggtttaaacggttttaaccgtttaaccggttaccggttaaccgttaaacggttttacggtttttacccgggtacccggggttccgttttaaacccgggacccggtaaaacggggttaaccgtaaacgggggttaaacgtaaaaccgttaccggaaaaacccgggtttaacgttacggggttacccggtaaccgggttaacccgtaccgtaacccggttaacgttttacccgggttaccggttttaacccttacccggtttaacccgtttaccccgttacccccggttaaccttaacccggtttaacccggttaacgggttaacccgttacccggtttaaacccgg

SEQ ID NO: 16927 - DNA, 825 bp, Homo sapiens
  misc_feature: GYAE6OF02JCC6A.9.12.B01.1.454.CMB.1.raw
  modified_base (241)..(241): a, c, t, g, unknown or other
  misc_feature (241)..(241): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacggccaccatcaactgacaacgtccagccagagttgttttanacggcctaccgaacaaacaaagtaaacttacgttacgctttaggtactacacgactaaacggaaaaccgaaggaaccaacgtaccccttaccgttaaaacctcgtaccttacctaactttaaaccggtcgggtaccaacgttacccgtaccccggggtactaaaccgggttccccgggggtacccctacggtaaccccgtagtttaccggaacggttcgggcgtacgggtccgggttacgtacggggaactaacggtacttttaccgaaccgttacctcaacctaacgtccgaacgtcgaccgtcctgggacctacgggaccgttaggaaacggtacgttcgggtaacggtacgttaacggttttaacgttacgttaccgttaacctaacggttttacgggttttacccggttcccggggtaccggtttaccgggtaaacccggttaaacgggggtaaaccgttaaaccggggttaggtaaaaccgtttaacgggtaaaaaccggttaaccggttagggtcgggttacgtacgtacccgtaaccgtaccgtttaccgttacggtttactttaccggttaacccg

SEQ ID NO: 16928 - DNA, 811 bp, Homo sapiens
  misc_feature: GYAE6OF02JJ6CE.9.12.B01.1.454.CMB.1.raw
  modified_base (205)..(205): a, c, t, g, unknown or other
  misc_feature (205)..(205): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtcctccagactccctggctgtgtctctgggcgagagggccaccatcaactgacaacgtccagccagngtgtttatacggctaccgacaacaagaactactagcttggtatcagcagaaaccagacacgcctacctaaactcgacttacacttaaccgtgggacacgtcctaacccggactaaaccggttccccggggccctacgacccgtattaccgagtacggacgtacggacggggttcgtacggggaactaggtactttacgacctacctacctacccgattcccgaacggtacctacgtaccccgttcggaccgtaacggtaccgtaaggtaacggtaacgtacgggttacgggtaacgtttaaggtttttaacgtttaacccgttaggttaaccctaaaccgttttaaccgggttttttaccggtaacccgggggttccggtttaacccggtacccgggttaaaaccgggtaaacccggttaacggggtaaacgggttaaaccctaaaacgggttaaaacccgtaaacgttaacggtacggtacggttaccgtaccggtaaccctaccgttacccgtttacgttacccggtttaccttaacccgttcccgttttaaccccgtacccgttacccgttacgttaaccggtaaccgttacggttaaacccg

SEQ ID NO: 16929 - DNA, 570 bp, Homo sapiens
  misc_feature: GYAE6OF02F4R9N.9.12.B01.1.454.CMB.1.raw
  modified_base (210)..(210): a, c, t, g, unknown or other
  misc_feature (210)..(210): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttanacggctaccgacaaacaagaactacttagcttggtaatcaggcaagaaaccaggacagcctactaaactgctcataacgtggcatctaccggcaagtccgggtcctagaccgtattcgagtcgcagtcggtactgggacagtattcactctcactatcagtcagtctgacacggctagaacgtgtgtaggtactagtttaactactgtacaacttgtttacgcggtcgttcggaccgtaagggaccaaggtacggaaactaccgtaaacgaacgtacggtagacttaggacctaacgacttcggtcgttactccgtaacgttacccttccgtacctacttacgtacgaacggtacctacg

SEQ ID NO: 16930 - DNA, 645 bp, Homo sapiens
  misc_feature: GYAE6OF02HV9FC.9.12.B01.1.454.CMB.1.raw
  modified_base (430)..(430): a, c, t, g, unknown or other
  misc_feature (430)..(430): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttatacggctccgacaacaagaactacttagcttggtatcagacaagaaaccaggacacgcctacctaaactgctctaattaacgtgggacactccgtacccggactaacgtcccggggtccctagaccgtattcgaggtcggacgacggcggggttacgtggggactagtaacgtttcacgttctaccacactcagacacgcgtcgcgaggtctaaggaagtntggtggtacttaagtttacttacgttacgttactaacgttacgtttttccgtacggggtaccggttccggaaccgtaacggggaaccgtaagggtagtaaaactacgaaaacgttacgtaggtacggtctacggaccaccgtacgtacgtttaccgttccttaccgtactttccgtaccccgtactacttaaccggtacgtaacgtacgttaccg

SEQ ID NO: 16931 - DNA, 576 bp, Homo sapiens
  misc_feature: GYAE6OF02FWFBW.9.12.B01.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (569)..(569): a, c, t, g, unknown or other
  misc_feature (569)..(569): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagatgtttanacggctccganaacagaactacttagcttggtatcagcaagaaaccaggacagaccctacctaaactgctctattaacgnggcatcctaccggacacgtccgggtccctgaccgattcagtgcgagcggtctgggacagtacttcactctacaccatacgancgtacncgtacgcgagcgtagaagcgtgngtcgtagtttacttactcgtactacgtagtttccgtacggtcgttaccggaccggtaaggaccgtaagggtacgaaacgtaccgtaaacgacgttacggaacggtctaacgggacctaccgtaatacccgttgttacccgttntaacccg

SEQ ID NO: 16932 - DNA, 622 bp, Homo sapiens
  misc_feature: GYAE6OF02FTIXB.9.12.B01.1.454.CMB.1.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagaactacttagcttggtatcagcagaaaccaggacagcctcctaaactgctcattaactgggcatctacccggcaacgtccggggtcctgaccgattcagtggcaggcggggtctggggacagtacgtttccactcctccacctagtacagacacgcctgcaggctggaagattggtcggctaagttttacttacgttcgttactaacttacggtttttccgtccggggttccggtttccgggaccgtaaacgggaacccgtaagggtacggtaaacgtaccgaaaaccgtaacgtcggtaggtaccgtcgaccgacgtacgttccgtaggttacccttactaccgttcccgttaccccgacctacgttaccgtacggaaccgtacggttaaccg

SEQ ID NO: 16933 - DNA, 738 bp, Homo sapiens
  misc_feature: GYAE6OF02IKM3O.9.12.B01.1.454.CMB.1.raw
  modified_base (219)..(219): a, c, t, g, unknown or other
  misc_feature (219)..(219): n is a, c, g, or t
  modified_base (321)..(321): a, c, t, g, unknown or other
  misc_feature (321)..(321): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaagtccagccagtagtttgttttanacggcctaccgaacaaacgaaacgtaacttacgttagtcgttggtatacgagacaaggaaaaccaggacacgtccctaacctaatcgctactaacttaacgngggccacgtccgtaacccggactaaccggtccccggggtcctacggacctagttccgaggtcggcgtagggcgggttacgtaggggactagtactttccacttcaccacctatacacgacaccgtcctagacgtcggtactagtaagtacgtggtacgtacgttaacgttttacgtaccgttagttaccgttaacgtttacggttttccgggtacgggttccggttaccgggaccgggtaaccgggtaacggttaaacgggtaacgggtaaactaaccgtaaaccgtaacggtttaggaccgggttacttaccgacccgtaaccgtcgttccgtttaccgtttaccttaccgttaacccgttccccggttaccccgttaccgtacttaccggttaacgtaccggttacgttaaccgg

SEQ ID NO: 16934 - DNA, 550 bp, Homo sapiens
  misc_feature: GYAE6OF02FMSIM.9.12.B01.1.454.CMB.1.raw
  modified_base (211)..(211): a, c, t, g, unknown or other
  misc_feature (211)..(211): n is a, c, g, or t
  modified_base (379)..(379): a, c, t, g, unknown or other
  misc_feature (379)..(379): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacggctccgacaacaagactactagcttggtatcagcaagaaaccaggacagcctacctaaactgctctaattaactgggcatcctacccggcaacgtcccggggtccctgaccgattcagtggcaggcggtctgggacagtactttcactctcaccatcagcagccngcgaggctagaagtatggtgtcgtaagtttatacgtcgtactaacgttgtttcgcggtcgttcgaccgaagggacgaggtagaactacgaaacgacgtggtgtcgtacgccacactcgtcgttacttacgtacttcccgttcccgacctagttacgacgtacggtactacg

SEQ ID NO: 16935 - DNA, 615 bp, Homo sapiens
  misc_feature: GYAE6OF02IS7IC.9.12.B01.1.454.CMB.1.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (599)..(599): a, c, t, g, unknown or other
  misc_feature (599)..(599): n is a, c, g, or t
  modified_base (610)..(610): a, c, t, g, unknown or other
  misc_feature (610)..(610): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcggtgatcgacccagtcctccagacctccctggctgtcgtctcgtgggcgaggacggccacctatcaactgacaacgtccacgccagngttagttttagaccggctaccggaacaaactaaagaaccttacgttacgcgttaggtacncagacaagaaaccgagacncgaccttacgtaaactgactacaagtttaacgtcggcacttcccgaacccgtacgtaacgtccccggggtccctacgaaccgtactttcgaggtcggacgcgggtcggttacgagggtaacngttacctttcactcctacacctnacgacactcgcgtaagcacgcgtagaagngtcgngtactagttctagtcgactacgttaggtttcgcggttcgaccgtacggaccggagtacggttaacgaaacttacgaaacggtactgacgtacgctccgaatcgtctcgtctacgtctccgcgctacngtacgtacgtntaacg

SEQ ID NO: 16936 - DNA, 761 bp, Homo sapiens
  misc_feature: GYAE6OF02JHZ6G.9.12.B01.1.454.CMB.1.raw
  modified_base (223)..(223): a, c, t, g, unknown or other
  misc_feature (223)..(223): n is a, c, g, or t
  modified_base (433)..(433): a, c, t, g, unknown or other
  misc_feature (433)..(433): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagacctccctggctgtgtctctgggcgaggacgggccaccatacaactgacaagtccacgaccagtagttagttttanacggcctaccgacaacaacgaactacttagtcttaggtatacagacaagaaaccgagacaacgcctaccgtaaactcgctacattaacgtgggtacctacgtaccgtaaccccggacctaacggtaccccggggtcccgtacggacccgtaattcgaaggtcggacgtacgggcgggtacgtggggaccaggtaattccaccgtttaccnccgtaacctagtacgaggactacgaccgtcgacgtaaggtcgaagtaacgaggttacggtcggttaacgttacggttttaactttacggttaccgtaacgttaaacccgttttacggtttttaccggtacccggggttccgtttaaccggggaccggttaaacccgggggtaaccgtaaaggggtaaccgtaaacgtaaaccggaaaaccgttacggtacggtacggttcggtacgtaccgtaaccggaccgttcgttacgtttccttaaccgttacccttcccgttaccgtaccgtaccttacggaccggttacgtaccgttaaccg

SEQ ID NO: 16937 - DNA, 831 bp, Homo sapiens
  misc_feature: GYAE6OF02GS1HM.9.12.B01.1.454.CMB.1.raw
  modified_base (129)..(129): a, c, t, g, unknown or other
  misc_feature (129)..(129): n is a, c, g, or t
  modified_base (144)..(144): a, c, t, g, unknown or other
  misc_feature (144)..(144): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
tcagtgatacgtctcacgaccggtgctcgatttagtagtgtagattccgcgggggagcgtacaacaggcaggcagggcagcaagatggtgttgcagaccaggtcttcatttctctgttgctctgatctntgtgcgtacgggacntcgtgatcgaccagtcctccagactccctggccttgtcgtcgtcgtggggaccgtagggacgggccctaacgacttcaaaccgtgacgaaacgtccaacggtccaaggttacgtttntttttacgaccggtcctaccggaanaaacctaagtaaaccttaacttacggtatttacgggttaaactccgtaaggtaccaaacgtaaaccgaacgggaactacggtacccttaacctaaaacggtctacctaccgttaaattaaccggtgggacctagttacccgtaacccggacgtaaacggttccccggggtaccttacccggaaacgtacgtttcgaacggttacgggctaacggggcgggttaccgtagggggaaaccttaaccggttagtttttacccaacgttttacccgtaccgaaaccttcctaacccgtaaagtcccggtaaacggtcccttaacggaccgaagggttaccgaaggttaaaccgagggttccgtagggttacccgtttaaagttttactttacgtttaaccggacgttaaacttttaccggggtttacgtcggggtttaccgcgtttaccggaacggtaaacgggacggttagaaaccgtaactaaacggggttaacaacggtggtaacccgtagtacccgaactccggtactttcggattacccctacg

SEQ ID NO: 16938 - DNA, 784 bp, Homo sapiens
  misc_feature: GYAE6OF02H5NSG.9.12.B01.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagacgtnttttanacggctccgacaacaaagaactacttagcttggtatcagcagaaaccaggacagcctacctaaaactgactacaattaaactgggacagtcctaaccccggcaacgttcccggggtaccctcggtaaccgacttcgagtcggacaggtccgggttactcggggaacacggtatttaccacgttactaccaaccattaccaaggaccaacggtacccttaggaccgaaacgggtcttaaacgggaaagtaggttcggttacgggtaccgttaaagtttttaacgttaaccgttacgttaaccgtaaaaccgtttaggttttttaccgggtccggggttaccggttacccgggtaaccgtaaaaccggggtaaacccgtaaacgggttaaagggtaaaactaaaccggtaaaaaccggttaaaaccgttacgggttaaccggtccgttaaccgacccgtaaacccgtacgtttaaccgttaacggtttaccttaaccgttaacctttacccggttaccccgtaaccccgtacctttaacccggtaacgggttaaaaccggaacccgtttaaacg

SEQ ID NO: 16939 - DNA, 701 bp, Homo sapiens
  misc_feature: GYAE6OF02HFTYG.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgctacggggacatcgtgatgacccagtctccagactccctggctgtgtctctgggcgaggagggccaccatcaactgcaagtccagccagagtgttttatacggcctccgacaacaagaactacttagtcttggtatcagcaagaaaccgaggacacgcctacctaaactcgcttacaattaacgtcgggcacgtccgtaccccggactaacgttcccggggtacctcggaccgtattcgacggtggcgaggtcgggtcgtgggactagtattctacttctcaccactcgacgcacgcctagacgaggtcgtaagaagtcgttggtcgggtacgttaaggttttacgttaccgttaggttacctaacgtttacggtttttccggtaccggggttaccggttacccgggtaacgggtaaccggggtaaccggttaacgggtaaacgttaaacgttaaccgtaaaacggtaaaccggtggttaccggttaccgacgaccctaccgtacgttcgttaccgtttaccgttccgtacgtttaccccgttacccggacccttaccggttaccggtaacggttacgtacgggttacc

SEQ ID NO: 16940 - DNA, 770 bp, Homo sapiens
  misc_feature: GYAE6OF02GCAQE.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagacctccctggctgtgtctctggcgagacggccaccatcaactgacaagtccagccagtagttgttttacgaccggtctaccgaacaaacaagaaccttacgttagcttaggtactcgagacaagaaaccaggaacacgacccttaccgtaaaactcgtaccttactaaacgtttaacggtgggcctaacgttacccgttacccgggacgttaaacggttccccgggggttacccctacggtaacccgttaactttccggaaggttcgggacgaacgggtccggggttacgtaccgggggaactaagggttaacttttacccgaaccgtttcccgtaccctaaaccgtacgttaccgaacggttaccgaaccgtcccgttacggaccgtaacgggtccgtaaggtaaacgtacggttaggtacggtcgttaagttttacgttaacttggtaaaccttaacgtttcggttttaccgtacggggtttaccgttccgggtaaccggaaccgggtaacgtaacggttacgtaaacgaccggtaaacgaacgttcggtaacggtcgttaacgactacccgttacttcgtaccgttactcttaacccg

SEQ ID NO: 16941 - DNA, 669 bp, Homo sapiens
  misc_feature: GYAE6OF02G6YBU.9.12.B01.1.454.CMB.1.raw
  modified_base (214)..(214): a, c, t, g, unknown or other
  misc_feature (214)..(214): n is a, c, g, or t
  modified_base (423)..(423): a, c, t, g, unknown or other
  misc_feature (423)..(423): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgaccagtctccagactccctggctgtgtctcgtgggcgagacgggccacatcaactgacaagtccagccagtagttgttttanacggctaccgacaacaagaaccttacttagtcgttaggtataccgagcaacgaaaaccaggacacgcctactaaactgactcaattacgtggacagtccgtaccggacaacgtccgggtaccctagaccgtacttacgaggtgcgacggtcggtacgttagggactagttacgttcacgttcgtaccaactgtaccagactacggtccngacgtacgaccgtggaacgtacgttgacggttactaagtttaactcgtacgttaccgtaagtttacggtttccggacggttaccggtaccggtacggaaaccggtaacggtaacggttaagaaactaacgtaaacgtaacggtagtacggtccgtacaccggtaactcgtttcggtacctttacgttacccgttacgtttcccgtacccgtacgttaccggtagaaccgttagacccgtttaaccg

SEQ ID NO: 16942 - DNA, 702 bp, Homo sapiens
  misc_feature: GYAE6OF02IGID6.9.12.B01.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (496)..(496): a, c, t, g, unknown or other
  misc_feature (496)..(496): n is a, c, g, or t
  modified_base (551)..(551): a, c, t, g, unknown or other
  misc_feature (551)..(551): n is a, c, g, or t
tcagtgatacgtctcacgaccggtgctcgatttagtagtgtagattcggcggggggggggtctcaggaggcagcgctctcaggacgtcaccaccatggcctgggctctgctcctcctcaccctcctcactcagggcacgaggtcctgggcccagtctgccctgactcacgcctccctccgcgtccgggtctccgtggacngtcgcacatctcctgcactaggaccagcagtgactgttggngtcttaataactatcgttcctccgtaggtaaccaacgcaccgaccgaaggaccaaaccgtaccccaaaactctaattcgtaacttttagtaggtaacggtactaaacgtaacgtcccggaccctttcgggtaccggggtccctaggtacgtccttacgttcctcggtcgtacctacgtaacgtcgacggtacaaccggtacccgtcctccctacggtccctactcgggcgtcctcgacggtcgtgacgtgtacgnggtctagtaatttacacgtcgacgtcgtactctaaacgttcgtacgacgtaaccnccgaaccgtaactaacgtccgttaacggtacgggtaacggtacccgggtaccgtaccggtcccgtaacccggttaacccgtacggtacccgtaacccgacccggtaacccggaacccctccgttaacggtcctaccgttaccttaccccgg

SEQ ID NO: 16943 - DNA, 775 bp, Homo sapiens
  misc_feature: GYAE6OF02H21AS.9.12.B01.1.454.CMB.1.raw
  modified_base (142)..(142): a, c, t, g, unknown or other
  misc_feature (142)..(142): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagtgatacgtctcacgaccggtgctcgatttagtagtgtagattccgcgggcagcaagatggtgttgcagacccaggtcttcagtttctctgttgctctggatctctggtgccgtacgggacatcgtgatgacccagtcnccacgacctccctggctgtcgtctcgtgggcgagacggccacatacaacgtgaccaacgtccagccagtagttcgttttacacggcctaccggaacaaacaagtaacctacgttacgcttaggtatcngacaacgaaaccaggacacgcctaccaatgctactaacttacgnggcacgtcgaccggctacggtccggtcctaggacctcttcgagtcggcaggtcggtgtgggactagtaacttcacgtcacgactactcgagaccaccggtccgttaggacgtacggtaccgtaagtaacggtagttacgggtacggtacgtttaacggttttaacgttaaccgttacgttaactttaaaacgtttttccggtttacccggttacccggggttacggttttaaccccggggaaccggttaaaacggggttaaaccccgggtaaagggttaaacccgggtaaaaacggtttaaccggaaaacggttaaccgggttaaaccggtcggggttaaccgtaccggttaacccgaaaccgttccggttccgttaaaccggtttccttccgttaacccgtttacccggttacccggttaactaacccgttccggttaacgtacccggtaattacccggg

SEQ ID NO: 16944 - DNA, 641 bp, Homo sapiens
  misc_feature: GYAE6OF02GW2FE.9.12.B01.1.454.CMB.1.raw
  modified_base (333)..(333): a, c, t, g, unknown or other
  misc_feature (333)..(333): n is a, c, g, or t
  modified_base (605)..(605): a, c, t, g, unknown or other
  misc_feature (605)..(605): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttttatacggctccgacaaacaagaaccttacttagtcttggtactcagcaacgaaaccaggacagcctacctaaactgctctattaacgtgggcatcgtacccggctaacggtcccggggtccncgaccgtattcaggtggaccagggccgggttcgtacgggactacggtacttttccaaccttcctaccacctactaccacggtccacgtccgtacggaccgtacggctaggaaacggtagttggtacggtcgttaaacgtttttactacgttacgttaacttaaccgttacgttttccggtaccgggttcggtccggtaaccgaaccgggtaacgtaaggtacgaaacttacgaaacgtactggagctagacctactctcgttgttccttacncctttcccgtaccctcgtatccgtagactggtaacc

SEQ ID NO: 16945 - DNA, 648 bp, Homo sapiens
  misc_feature: GYAE6OF02FU0V6.9.12.B01.1.454.CMB.1.raw
  modified_base (211)..(211): a, c, t, g, unknown or other
  misc_feature (211)..(211): n is a, c, g, or t
  modified_base (258)..(258): a, c, t, g, unknown or other
  misc_feature (258)..(258): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttancggctaccgacaacaagaactacttagcttaggtatcagcagaacgngacagcctctaaactgctactattaactgggactatccgtaccgcaacgtccggggtcctacggaccgtattcagtcggcaggtcggttcgtgggacctaagtactttacacgtcctcacctaactcgaactccgacgtccttgacgacggtacaggtaaacgtagtggtacggctaacgttttaataccgttggtaaccaacgttcgttttcgtacggggtccgttaaaccgggccggtaaacgggtaccaaacgggttacggaaacgttacgtaaaccgtacgttacggtacggtacgtaccggaccctaacggtacttaacggttccttacgttccgtactttcccgtacccgtcctaaggttacctggtaacctaccgtttaaccg

SEQ ID NO: 16946 - DNA, 939 bp, Homo sapiens
  misc_feature: GYAE6OF02ICLUA.9.12.B01.1.454.CMB.1.raw
  modified_base (198)..(198): a, c, t, g, unknown or other
  misc_feature (198)..(198): n is a, c, g, or t
tcagtgatacgtctcacgaccggtgctcgatttagtagtgtagattccgcgggcagcaagatggtgttgcagacccaggtcttcatttctctgttgctctggatctctggtgacctacgggacatgtgatcgacccagtcctccaagacctcccgtggctggtgtctcgtggggcgaggacggccaccatacaaactnacaagtcccagacccgaaggtacgtttcgttttaacgtaccgtacccgtaccgaaacctaaaacgaagtaaaccttacgttacggacgttaggtactacgacggacaaaacgaaaccgaacggacctaaccgtaccttaaacccgtaaacgttctaactactaaacgttaacggtcggggtcctaacgttacccgtaccccgggacgtaaccggttccccgggggttaacccctcggaaaccccgttacgtaccggtacgggtcgggaccgtacggggttcgggtaccggagggtaaccgttaaggtaccttttcccgaaccttacccgtacctaacccgtaactacgacgaccgtacggttacctcggtacggaacggtacgtaaaccggttaagtaggtacgggttacgtaacctttaacgggtttttcctaaacgttaccgttaaacgtttaaccggttttaaccggggtttaccggtttccggggtacccggtttaacccggaaccggggtaaaccgggttaacccgggtaagggtaaacccgggtaaaaccggttaaacccgtaaacgggtttaacgtaccggggtaactccgggttaaacgtccgttaacccgttacggttaaccctttaccgggttttccctaaccccgtttaaccggtttacccccggttacccgtttaaacccggttccgttaacccgttaaaccgggttacccggttaacctttaacccgg

SEQ ID NO: 16947 - DNA, 770 bp, Homo sapiens
  misc_feature: GYAE6OF02HQO9V.9.12.B01.1.454.CMB.1.raw
  modified_base (480)..(480): a, c, t, g, unknown or other
  misc_feature (480)..(480): n is a, c, g, or t
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagactcccgtgctgtgtctcgtggcgagcgggccacatacactgactacgtcacgccagtagttagttttagtacggtcctaccgaacaaacgaaacgaaacttaacgttacgtcgttaggtactacgtagaccgaagtaaaaccgaacggaactacgacccgttacctaaacgtcgacttaactaacgttaacgtacggacctacgttaacccgtaccccggaacgtaaccggttccccggggttacccaccggtaaccgtaagttcgaggtcggtacgacgggtacgggtcggtagggacgtagttacttaccgaactctaccgactacgacncgacgtacgctacggacgcggtacgtaggaaggtacgtggttacggtaacgttacggttttaactttacgtcgttaaccgttaacgtttacggtttccgggtcgggttaccttaccgggtaacgtaaaccgggtaacgttacgggtaaacgtaaaccttaacggaaaaccgttacgtgtaccggtcgttaccgacccttaagttcccgtaacggtttccttaacgtttcccgtaccgttaccccgtcccgttacctaacggtttacgaacggttaaccgacgtttaaccg

SEQ ID NO: 16948 - DNA, 672 bp, Homo sapiens
  misc_feature: GYAE6OF02F3BGP.9.12.B01.1.454.CMB.1.raw
  modified_base (392)..(392): a, c, t, g, unknown or other
  misc_feature (392)..(392): n is a, c, g, or t
  modified_base (432)..(432): a, c, t, g, unknown or other
  misc_feature (432)..(432): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgaggacgggccaccatacaactgacaagtccagccagagttgttttagtacggctccgaacaacaagtaacttactagtcttggtatcagcaacgaacgaggacaacgccttaccaaactgtacctctaacttaacgtgggcctacgacctaccccggacaaccggtcccggggtcctacgaccgtactttcaggtacggcgtagccggtctagggacctagtntttaccgacttccgtaaccactacgtaccgagtaacccgngtacccgtggacctaacgggtctaaggaaagtacggttggtacgtacgttacgttttaacttcggtacgttaaccgtaagtttcggttttacccgccgggttacgtttcccggacgtaaccggggtaactacggtaaacggtaacgtaacgaaaccgtaagtcggtacgtccgtgtacgactagtccgttagccttcggacgtttccaccttccgtagtaccgtaggtaccgtgttaacc

SEQ ID NO: 16949 - DNA, 705 bp, Homo sapiens
  misc_feature: GYAE6OF02JSFZC.9.12.B01.1.454.CMB.1.raw
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
  modified_base (488)..(488): a, c, t, g, unknown or other
  misc_feature (488)..(488): n is a, c, g, or t
  modified_base (613)..(613): a, c, t, g, unknown or other
  misc_feature (613)..(613): n is a, c, g, or t
  modified_base (678)..(678): a, c, t, g, unknown or other
  misc_feature (678)..(678): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatcgacccagtcctccagtacctcccgtggtcctggtcgtcgtcgtcgggccgaaggacgggcccaactactacaactggctaaaggtcccaaggccaggtaagttcgtttttaagaccgggtccttaccgaaactaaaccgaaacgtaaacttacgtttacggccgttttaggtaacncgtacgaacaaaccggaaaccgaaggaaccgtacgacccttaacctaaacncgtctactaacgttaacgtggacacttccgacccggagtaaccgtccgggtcccctaggtaccacgttcgacggtccgagtccgggtcgggctaccgggaactcgtacttccaacgtcaccaacgtcanacgaccgcgtacctgcgacggtactaagtacgaagtcgtaggttacttagtttacgtactaggttacacgtttaacgttcgtaggtccgtagccgtaaggactacggtaagtaccgaagttaacncgttaagacgcacggcttaccgacgttaccttgtaccttaaccggtcttaccccgttggaacccncgtttaaccgggactacgtacggttcc

SEQ ID NO: 16950 - DNA, 692 bp, Homo sapiens
  misc_feature: GYAE6OF02JHGB7.9.12.B01.1.454.CMB.1.raw
  modified_base (322)..(322): a, c, t, g, unknown or other
  misc_feature (322)..(322): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatcgacccagtctccagactccctggctgtcgtctcgtgggcgagacggccaccatcaactgcaacgtccagccagagttgttttacaccggctccgacaacaacgacttacgtagcgttagatcagcaagaacaggacacgcctacctaactgctactacgttaacgnggacctacgtccgtacccgacgtaaccggttccccgggtacctacggtaacccgtagtttccgaagttcgggacgacgggttccgggtacgtacgggaactacggttactttcccgactcctaaccgacctactccgaacgtccgtacgtccgtacgacgaccgtacgtaacgtaacgtacgttcggtagtcgtttaacggtttactaacgttacgttaaccgttaacgttccgttttaccggccgggttaccgttccgggaaccgtaaacggtacgtaacgggtagtaaacgtaaccgtaaacggtacgttacggtcggtacgtacgtaaccgcgttaaccgtccggttaacttccgtacgttaacccg

SEQ ID NO: 16951 - DNA, 718 bp, Homo sapiens
  misc_feature: GYAE6OF02FZVPG.9.12.B01.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (395)..(395): a, c, t, g, unknown or other
  misc_feature (395)..(395): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctcgtgggcgaggcgggccaccatcaactgacaagtccagccagngttgttttagacggctccgaacaacaagaacttacgttagcttaggtatcacgacaacgaaaccaggacagccctaacctaaatcgactctaattaacgngggacctactccgtacccggactaaccggtcccgggttccctagtaccgtattacggagtcggcgaggtcgggttcgtagggactacgtnttaccgtactctcactgtacgcgacacgccgtgaccggagtacgtacggaagtggtcggtaaggtcgtttaagtttacttacgttacgtaaccgttaacgtttacggttttccggaacggggtttcccggttacgggaaacccgggtaaaccgggtaaggtaaacggggttaagtaaaacccgttacgggaaaaccgttacggtacggttaacggtaccgtaccgtaccgtaaccgttcgtttaaccggtacctttaccggttaccttaaccccgtcccgttaccctaccgttacgtacgtaacggtaacgttaccgtaaccg

SEQ ID NO: 16952 - DNA, 605 bp, Homo sapiens
  misc_feature: GYAE6OF02JXLPM.9.12.B01.1.454.CMB.1.raw
  modified_base (212)..(212): a, c, t, g, unknown or other
  misc_feature (212)..(212): n is a, c, g, or t
  modified_base (402)..(402): a, c, t, g, unknown or other
  misc_feature (402)..(402): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttanacggctccgacaacaagaactactagcttggtatcagcaagaaaccaggacagcctactaaactgctcattaacgtgggcatcctacccggcaacgtccggggtacctcgaccgattcgagtcggctacggcgggtctagggacaggtatttcgactctcgaccatcagcagccgtcgcgagcgagaagntaggtgcgttaagttacttaacgtgttactaagtcgttttacgtcgggtcgttacggaccgtaagggaccgtaaaggtacggtaaactacgtaaacgtaacgtacggtcgtacgtacgacctaccgtagtccgttaggttccttaccgttaactcccgtttacccggaccttaacgtccgtacggtaacggtaccgttaaccg

SEQ ID NO: 16953 - DNA, 822 bp, Homo sapiens
  misc_feature: GYAE6OF02GREAI.9.12.B01.1.454.CMB.1.raw
  modified_base (90)..(90): a, c, t, g, unknown or other
  misc_feature (90)..(90): n is a, c, g, or t
tcagtgatacgtctcacgaccggtgctcgatttagtagtgtagattccgcgggcagcaagatggtgttgcagacccaggtcttcatttcnctgttgctctggatctctggtgcctacggggacatcgtgatcgacccagtctccagacctccctggctgtgtcttcgtcgggcgaggacgggtcccaaccactacaacgtcgacaacgtaccacgcccaggtagttacgttttacggaccggtccctaccgaacgaaacgaaaggttaaaccttacgttaagtcgtttaggtaacctcaaggacgtaaccggaaacgtaacggaaccgacgtaccgttacccttaaacgtcggtcctaaccttaacttacgtacgggctaacgttcccggtaaccccggactaaccgggtaccccgggttccccgtacggtacccggtaatttaccggacggttaccggacgtacgggtacccggggttacgttaccggggaacgtttcgttagtttaccccgtaacttcccaccgtaccgaacttaccgagtacccgaacgtcccgttagacgtacggtacggtacgtaagtacgttgggtaccttaagttacgtttctaacgtgttaaccgtactttcgttacgtcgggtcgttaccgaaccgggtagtaaccgtaaagggttaacgtaactaaaccgtaaacgtacgttcgggtaccggagttacccacgtttaacgtccttacggttaacccttggttaacccgtaccgtttacccgtccccgtttacgtacgttaccccggtaacgggtaccccgttattaacccgg

SEQ ID NO: 16954 - DNA, 670 bp, Homo sapiens
  misc_feature: GYAE6OF02F8NE4.9.12.B01.1.454.CMB.1.raw
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatcgacccagtcctccagacctccctggctgtcgtctcgtgggcgagacgggcccaacgatcaactgacaacgtccagccagtacgttagttttacaccggctaccgaacaacaagtaacttacgttagacgttaggtactaccgagactaacggaaaccccgaggaccaggtacccttaaccgtaaaacgtcgaccgttacaacgtttaaccgtcgggactacgttacccgtaacccggactaaacggttccccggggtaccctacggaccgtagtttccgacggttcggactacggcgggttactcggggaacagtacttttcacgttcctaccaacctagtccagtaccacgtccgtagcgacggtctaggaagtcgttgcgtacttagtttactcgtacgtaactacgttacgtttccggcggtcgttaaccgacgtaagtaccgaaggtacgtaaacaccggtaaatcgtacggtcgactcgacacttcgttacctcgttacctgttacccg

SEQ ID NO: 16955 - DNA, 709 bp, Homo sapiens
  misc_feature: GYAE6OF02G0FHH.9.12.B01.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (680)..(680): a, c, t, g, unknown or other
  misc_feature (680)..(680): n is a, c, g, or t
tcagtgatacgtctcacgaccggtgctcgatttagtagtgtagattcggcggggggggggtctcaggaggcagcgctctcaggacgtcacaccatggcctgggctctgctcctcctcaccctcctccactcagggcacgagggtcctgggcccagtctcgccctgactcgacgcctccctccgcgtccgggtcctccgtggacagtccggtcacctatctcctgcactaggaaccngcagtnactagtggtnacttagtaactgtacgtctaccgtaggtaacctaacgacgacccaaccgaggaaccaaaaccgtaaccccaaatacgtaacttaggtaactttacgtacgtaacgtaacgtaaacggtaccggcccggtaccgttcggtaccgggtacccgtagtaaccggttccgttaacttccgtcgtacggtacctaacgtaacgtcgttacgaaacccgtacgtaacccggtccctacccgtacggtaccgtcgtcggtacgacctacggcgtacgtacgacgtacgtggaggtaccttaggttacttaagttacctaggtaccgaagtcctaatacgtaacgtagacgacgtaccaaccacgttagaccggttagttacggacggtaccgtacgtacgtacccgtactcggacgtacgaccgtaaccgacccncccgtaaccgtctacgtctacgttcccgg

SEQ ID NO: 16956 - DNA, 654 bp, Homo sapiens
  misc_feature: GYAE6OF02FIEKV.9.12.B01.1.454.CMB.1.raw
  modified_base (171)..(171): a, c, t, g, unknown or other
  misc_feature (171)..(171): n is a, c, g, or t
  modified_base (214)..(214): a, c, t, g, unknown or other
  misc_feature (214)..(214): n is a, c, g, or t
  modified_base (447)..(447): a, c, t, g, unknown or other
  misc_feature (447)..(447): n is a, c, g, or t
tcagtgatacgtctcacgaccggtgctcgatttagtagtgtagattccgcgggcagcaagatggtgttgcagacccaggtcttcatttctctgttgctctggatctctggtgcctacgggacatcgtgatgacccagtctccagactccctggcctgtgtctcctggcganagggccaccaatcaactgcaacgtccagccagagtcgttttanaccggccttcccgacaaccacgaacttacttagccttggtatcgagcagaaaccctacggacagccctcctaaactgcctcattaacgtggcatctaccggcaatccgggtcctgaccgattcagtggcaggcggtctgggacagactttcgactctcacctatccagtcaagcctgcagcctagaagactgtcggctagtttactacttggtacctaacgtacgttttaccncggggtccgttaccggaccgtaacgggaccaaagggtacgtaaaagttaccgtaaaaccgtaaaccgttacggtacggtaccgttacggacctaaccccgaattttacccgacgggtttacccctttaaccgttacccgttccccgtttacccccggttacccgaacccgtttcccgttacggtaaaaccggtaccgtttaaacccg

SEQ ID NO: 16957 - DNA, 667 bp, Homo sapiens
  misc_feature: GYAE6OF02HOHEY.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcttgatgacccagtctccagactccctggctgtgtctcgtgggcgagagggccaccatcaactgacaagtccagccagtagttgttttatacggcctaccgaacaaacaaacgaacttacttagcttaggtatcagcaagaaaccgaggacacgaccctacctaaacgtgctactaattaacgtgggactactccgtacccggactaacgtccccggggtcctacgaccgtattacgaggtcggacgacgggtcgggtcgagggacctaggtactttccgacttcctacctaccgatacgacgtccacgtccgtagcgacggtactaggaagtagtgtacggtacgttaagtttacttacgtacttaccgtaacttagttttccggcgggtacgtccggaacgtaacgggaaccgtagggtaacgtaaactaacgaaacgtaacgtcggagtccgtacgaccgtacctagttcgtccgttaccttaccttccgttacccgttccccgtaactaccgttaccgtacggtacgtaccgttaccg

SEQ ID NO: 16958 - DNA, 801 bp, Homo sapiens
  misc_feature: GYAE6OF02G68KQ.9.12.B01.1.454.CMB.1.raw
  modified_base (153)..(153): a, c, t, g, unknown or other
  misc_feature (153)..(153): n is a, c, g, or t
tcagtgatacgtctcacgaccggtgctcgatttagtagtgtagattccgcgggcagcaagatggtgttgcagacccacggtcttcatttctctgttgctctggatctctggtgcctacggggacatcgtgatgacccagtctccagactcccngggctgtgtctctgggcgagagggccaccatcaactgcaagtcagccagagtgttttatacggctccgacaacaagaactacttagcttggtatccagcagaaaccaggacacgccgtacctaaactgactccgtaatttaacgtgggactactaccgtaccccggaccaacgtcccgggggttccctacgggtaacccgtatttaccacgggttggtacctaagggtcggggttaccgttaggggacctaggtaacttttaccggaccttacgttaccaaccgtacgttacccgaacgggtacctaaacggtccccgttagggtacccgacggggtacccttaagggaaaacggtcgttaggggttacggtaccgttaaaggtttttaacgtttaaccggttacgggttaccgtaaaccgttacggtttttaccggttccgggggtacccggttttacggaacccgggtaaaggggtaacccggtaaaggggttaacggtaaaacgttacggtaaaacccgtaaacggtttcggtaacgggttcgaccgtaccgtaccctaacggttccgtacggttccttccgtaacgttttacccgtacccggttaccgtaacgtccgttaacggtaaccggtaccgttaaccgg

SEQ ID NO: 16959 - DNA, 889 bp, Homo sapiens
  misc_feature: GYAE6OF02GHL3M.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgcctacggggacatcgtgatgacccagtctccagacctccctggctgtgtctcgtgggcgagagggcccaccatcaactgacaagtccaagccagtagttagttttataccggctccgaacaaacaagtaaactacttagcgttggtatcagcaagaaaccaggaacacgtcctacctaaactgacctacgtaacttaacgtcggggtacaacgttccgtaaccccggaccgaaacgttccccggggggttaccccgttacggaacccggttaactttaccgtaagggttcggggaccgtacgggtcccgggggttaccgtaggggggtaaacctacgggtaaacttttacccgtccttacccgtaccaaacccttaacctcgaaccggaccgaccgacccgttcggaccgtacggggtaccgtttaaggaaagtacggttagggttcgggtaacgtttaaacggttttaactttaacgtttcgttaaacgttaaacccggtttacgtttttccggttaccgggggttacccgggtttacccgggaacccggtaaaaccgggggttaaccggtaaaacgggttaaccgggttaaaaccgttaaaaccgaaaaccgggtttaaaacggtcgggttacgggtaccgttaccggtaccgtaaacccttacggttaccttacgggtttacccggtttaccttaacccgttttccccgtttaacccccggtaccttacgtttaaccccggtacgggttaaacccgggttaacgtttaacccgg

SEQ ID NO: 16960 - DNA, 833 bp, Homo sapiens
  misc_feature: GYAE6OF02JANGT.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacgggacattcgtgatcgacccagtctaccagactccctggctgtgtctcgtggcgaggacggccacatcgaactgacgtaacgtccgagaccgagtacgttaggttttaacgccgggacttacccgacaaacaacgtaacttaccttagtccgtaggtaacttccgaaggacctaacgaaaccgacgggtaactccggtccttaacccggtaaaccttgacctactaacgttacggtacggacctacgttcccgaaccccgggtactaaccgggttccccggggtacccctaacgggtccccgtaaagtttccggacgggttacggaaccgtacgggtccggggtttccgtaacggggaccttaacggtttcctttaccaacgtcctaccgaaacctcggaacaaccgggcttaaacggcccgtagtacggtagaccgtaaggtaacgacggttggtaccgttacgttaacgttttctaacgttcgttaacttacggttaccggttttaccgggtacccggtcggtaaccgggttaccggaaccgggtaacggtaacgggttaacggaaacccgttaaggaaaccgttaccgacgggttaccgaccgttaccgaccgtaccggtacttacccgttaacccgtttctaaaccgttcccggttaaccccttccggtaaccccgttcgttaagtaacccgttaacggtaccgttaacgg

SEQ ID NO: 16961 - DNA, 687 bp, Homo sapiens
  misc_feature: GYAE6OF02GTV2E.9.12.B01.1.454.CMB.1.raw
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
tcagtgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagagggccacatcaactgcaagtccagccagagttgttttacacggctccgaacaacgaagaactacttagcttggtatcagcagaaaccagacacgacctactaacngctactacttacgnggacacgtacctaccgctaacgtcccggggtacctagaccgtacttcgacgtcggcgaggtcgggttcgtacggggtacacggttactttaccgtactacctaccgaacctacgtaccgtaacggcctaacggtccgtacggacccgtacggtacgtaacggtaaggtaacgttgggtacggtacgtttacgtttaacgttaccgttacgtaaccgttaacgtttacggttttccggtaaccggggttccggttacggtaacccggtaaaccgggtaacggtaacggtacggtaaacgttaaccggaaacggtaacgttcggtggtaccgtagaccgtaaccgtactacccggttcgttacctagttacccg

SEQ ID NO: 16962 - DNA, 725 bp, Homo sapiens
  misc_feature: GYAE6OF02FR5R3.9.12.B01.1.454.CMB.1.raw
  modified_base (360)..(360): a, c, t, g, unknown or other
  misc_feature (360)..(360): n is a, c, g, or t
  modified_base (686)..(686): a, c, t, g, unknown or other
  misc_feature (686)..(686): n is a, c, g, or t
tcagtgatacgtctcacgaccggtgctcgatttagtagtgtagattccgcgggcagcaagatggtgttgcagacccaggtcttcatttctctgttgctctggatctctggtgcctacggggacatcggtgatgacccagtctccagactccctggctgtgtctcgtgggcgagacgggccaccgatcgaactgacgaagtccagccaggtacgttgttttagaccggctaccgaacaaacaagaacctacttagcgttggtaactcacgcaacgaaaccgaggtacacgcccttacctaaactcgtcctacgtaattaacgtgggactactccgtacccggctaacggtcccgggtaccncgaaccgtcttacgacgtgggacgtacggccggtcggtagggaaccagttacctttacgaccttccacctacctactacgacgtacaccggtcgtacggcacggtacgtaagaagtgttagggtggtaccttagttttaaccgttactacgttaacgtaacgttttcggtttccgaccgggttcggttaaccggacggaaaccggggtaacgtaacgggtaagttaaaacccgtaacgaaaaccggttacggttacggagttaccgtaccgtactaaccggtactttcgtacccgtttcttacccggttccttacccggttacccncggttaccgtacggaaccggttaacgtaccgttaaccgg

SEQ ID NO: 16963 - DNA, 787 bp, Homo sapiens
  misc_feature: GYAE6OF02FFF5T.9.12.B01.1.454.CMB.1.raw
tcagtgatacgtctcacgaccggtgctcgatttagtagtgtagattccgcgggggagctacaacaggcaggcaggggcagcaagatgggtgttgcagacccaggtcttcatttctctgttgctctggatctctggtgcctacggggacagtcgtgatcgacccagtcctccacgactccctggctgtcgtctcgtgggcgaggacggccaccactcaaccgtcgactaacggtccacgccgagtagttagttttagaccggcctaccggaactaaaccaaggtaaccttaagttacgtcttacggtaactcgaacgtacaaacgaaacccgaggacacgtacccttacctaaacgtcgccgtacaacgtttaacgtcgggacctacgtacccgtacccggaccgtaacgttcccggggtaccctacgaccgtacgtcgacggtcggacgtacgggccggtacgttaacggggactacggtacgtttaccaccgttaccgtaccctaaccgtaacttccgaaacgtccgtaccggacccgttggacccggaggtaaccgtaggtaagtaaccggtggttacggtctttaaacgttttacgtaccgttacggtaacgttaaccgtttccggttttaccggtcgggttaccggttacccggtaaccggaacggtaacccggtaacggttaacgaaacgttaaccgaaaaccggttacggtaccggtttacggtacccgacgtaacccgttactaaacccggttctttacccgttacgttaccttaccccg

SEQ ID NO: 16964 - DNA, 710 bp, Homo sapiens
  misc_feature: GYAE6OF02HX1GI.9.12.B01.1.454.CMB.1.raw
  modified_base (107)..(107): a, c, t, g, unknown or other
  misc_feature (107)..(107): n is a, c, g, or t
  modified_base (164)..(164): a, c, t, g, unknown or other
  misc_feature (164)..(164): n is a, c, g, or t
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (480)..(480): a, c, t, g, unknown or other
  misc_feature (480)..(480): n is a, c, g, or t
  modified_base (503)..(503): a, c, t, g, unknown or other
  misc_feature (503)..(503): n is a, c, g, or t
tcagtgatacgtctcacgaccggtgctcgatttagtagtgtagattccgcgggcagcaagatggtgttgcagacccaggtcttcatttctctgttgctctggatctntggtgccgtacggggacatcgtgagtcgacccagtcctccagactccctggctggtntctcgtgggcgaggacgggccaaccataccaactggaccaaacgtccgagccaaggagtttacgttttaaacgaccggtccttaaccgaaacaaaacgaaacgtaacttaaccgtttagtccgttaggtaataccgacgaccgaagaaaacccgagggtaaacnctacccttaaccgtaaacgtctaccgttactaaatttaaaccggnggactaactaccgtaacccggntaaccgtccggggtcccaggtacctatacgtacgtgacgacgtcgggtcgtggacgacgttattacgactactaccacacgttanagacgtacgcctacggacagggngtaacgaaggtgtacggtgtaccgttaagttttacttacgtagtaccttaagttggtttccggtcggtcggtaccggtcggaaacggaaccggtagtaacggaactaaccgaaatacggtagcgtaacgcacgtaccgtacgtctacgtttcgtactaccgttacccttaccgttcgtaccttacgggtacgtaacggtacttaacg

SEQ ID NO: 16965 - DNA, 729 bp, Homo sapiens
  misc_feature: GYAE6OF02GT70Y.9.12.B01.1.454.CMB.1.raw
tcagtgatacgtctcacgaccggtgctcgatttagtagtgtagattccgcgggcagcaagatggtgttgcagacccaggtcttcatttctctgttgctctggatctctggtgccgtacggggacatcgtgatcgacccagtctccagacctccctggctgtgtctcgtgggcgaggcgggccaccatacaactgacaacgtccacgccgagtagttgttttaacgtacggcctaccgaacaaacaaagaaccttacttagtcgttaggtatacagacaacgaaaccgaggaacacgtacctacctaaactcgctactaagttacgtgggactactaccgtacccggactaacggtcccggggttacctacggaccgtactcgtaggtcggacgtacggtccggttacgtacggggaactaggttactttacccacttaccgtaccaactacgtacacggactacgccgtcgacgacggtactaggaacgtgttaggtcggttacgtttaacgtttacgttacttacggttaacgtaacgttttcgggtttccggtacgggttccgttaccgggaaccggttaacgggaacgttaagggtacgtaaacgtaacgtaaacggttaacgtaggtacgccgtaacgaccgtaaccgtacttcgttacgtacttaccgttacccgttacccgttcccgtacttaccggttctaaaggtaccggtaacttaaccg

SEQ ID NO: 16966 - DNA, 880 bp, Homo sapiens
  misc_feature: GYAE6OF02IEYPC.9.12.B01.1.454.CMB.1.raw
  modified_base (176)..(176): a, c, t, g, unknown or other
  misc_feature (176)..(176): n is a, c, g, or t
tcagtgatacgtctcacgaccggtgctcgatttagtagtgtagattccgcgggcagcaagatggtgttgcagacccaggtcttcatttctctgttgctctggatctctggtcgccgtacggggactatcgtgatcgacccagtcctcacgtacctcccgtgctgtgtctcgtgggngaggcggaccaccatacactcgacaagtcagccgagtagtttgttttaacgccggacctcgaacaaacaaacgtaacgttacttacgtacgtttggtaactcgacgactaaacgaaaacctaaggaccacgtaccctacctaaacgtcgtactacctaatttaacggcggtaccaaccgttacccgtaacccggaacgtaccgggtttaccccggggtcccgtaaccggtaaccgttcggttacgtaacgggtcggaaccgtacggggtccggggtacggtaacgggaccgtaatttacggttccctaacttacccgaaccgtaaccttaacgtacctaacggacccaacggttacccggtagtaccgggtaacggttaaccggttaaggtaaaacggttgtaccggggttagacgttttaaacggtttttaccttaacggttaccgttaaccggttaacgtttttacggggtttacccggtccggggtttaacccggttaacccgggaaccgggtaaacggtaaacggggtttacggtaaaccgtaaaacggtaacgttaaaaccggacggtttacggtacggtacgtacgtaccctaacgtttaccgtaacgtttcccggtttacttaacccgttacccgtttacccgtacccggttacttaaccgttaccggtaaaccggttaacgttaccgtttaaccgg

SEQ ID NO: 16967 - DNA, 869 bp, Homo sapiens
  misc_feature: GYAE6OF02I7YNQ.9.12.B01.1.454.CMB.1.raw
  modified_base (259)..(259): a, c, t, g, unknown or other
  misc_feature (259)..(259): n is a, c, g, or t
tcagtgatacgtctcacgaccggtgctcgatttagtagtgtagattcggcggggggggggtctcaggaggcagcgctctcaggacgtcaccaccagtggcctgggctctgcctcctcctcaccctcctcactcgagggcacgagggtccgtcgggcccagtcctcgccctgactcacgtccctccctccgccggtccgggtcctccgtagggactaggtccggtaccacctctcctcctggacctacgtacggaaaccnggacctaggtacgaacgttgttcggtacgtaccttaaagtaaccgttagtcgtaccttaccgtacggtaaaccaacgacgaccaacccgacggaactaaacccggtaacccctaaacgtctaacgttacgtaacgtttaagtacggtaacggtaacgtaaacggtaaccggtcccggttaccccttagggttaccggggttaccccttcgtacgtaccggttccttccgccgttccggtaaccgttaccgtaaaccggttcgtaccggtaacccgtaaaccggcccggtacccgttcccctaacgggtccccgttacgttaccgggtccggtaccggtaccggtccggtacgtaccggtaacggtacgtaccggtacgggttaccgttaacgttaacgtttaaccgttaccggttacgacggtaccgtacgtaccgtaacttcggtaccggtaccgaaccggtacccctaccggtaataccgttacgtaccggttaaccggacggttacccggaccgttaaccgggtcccgtaaaccggttccgtacggaccgtacccgacccggtaccgaaccccgtcccgtacgtaccgtccgtacccgttaccccgg

SEQ ID NO: 16968 - DNA, 507 bp, Homo sapiens
  misc_feature: GYAE6OF01AZLLI.34.36.D03.1.454.CMB.1.raw
  modified_base (456)..(456): a, c, t, g, unknown or other
  misc_feature (456)..(456): n is a, c, g, or t
tcagtacacgtgatcacgaccggtgctcgatttagctgcgtcacgatctctcttgggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaagcccccaaactcattatttatgatgtcgctagtcggccctcaggggtttctaatcgcttctctggctccaagtctggcaacacggcctccctgaccatctctgggctccaggctgaggacgaggctgattattattgcagctcacatacaaccattaacactctggtttcgngaggaccagtgaccgtctacgtcagcccaaggctagccccctggtctaccg

SEQ ID NO: 16969 - DNA, 561 bp, Homo sapiens
  misc_feature: GYAE6OF01BV4CF.34.36.D03.1.454.CMB.1.raw
  modified_base (424)..(424): a, c, t, g, unknown or other
  misc_feature (424)..(424): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctgtaccaacattacccaggcaaacgcccccaaactcattattatgatgtcgctagtcgcctcgtagggttctaatcgtcttctctgcctcatgtctggcaacgcgcctccctgaccatctctggactccgaggtctggaggacggagggtgtattatactgcncctcatactacattccactcgcctactccgtcgtatggttgttacgttttccgggacgggtaacgggaaccctaaaccgttcccgtaaccccggtttcccttaccggtacccaaccggacccccgtaagggtccccg

SEQ ID NO: 16970 - DNA, 669 bp, Homo sapiens
  misc_feature: GYAE6OF01CH6XO.34.36.D03.1.454.CMB.1.raw
  modified_base (316)..(316): a, c, t, g, unknown or other
  misc_feature (316)..(316): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtacacgtgatcacgaccggtgctcgatttagctgcgtcacgatctctcgttggggggggtctcaggaggcagcgctctcgggacgtctccaccatggcctgggctctgctattcctcaccctcctcactcagggcacgagggtcctgggcccagtctgccctgactcaggctgcctccgtgtctgggtctccgtggacagtcgatcaccatctctgcactgtaaccggcagtgacgttgatgattatagtctgtctctacggtaccaacaaccaccccggacaaacgcctacccaaactcatacgtatttanagtatgtacaagtaactccggcctagtaggttcgtttctctagtccgtcttctctcgtcctctattcgtacgtcgacctaaccgaccggtccctcccgtacgtaccctacttccgtccgttacgggtacccttacccggagggtccgttacgggaacgggtacccgggtaacgggtcccgaaccggtaccccgaaacgggtcccgtaccccggtccccccggttacgggttcccctaccgttcccgttcccggttcccccgtccccgtccttccgtactccgtaaccggttcggtaccgtgggtaccgggtcgggaccgtacggggaccgtaacgggccacgttacgngnacg

SEQ ID NO: 16971 - DNA, 571 bp, Homo sapiens
  misc_feature: GYAE6OF01DYJOR.34.36.D03.1.454.CMB.1.raw
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacacttacccaggcaaacgcccccaaactctatttatttatgatgtcgctagtcggccctcgtagggtttctaatcgcttctctggctccaagtctggcaacgaccggccctcctgaccatcctcgtcgggctccgaggtctggaggacgaggtctgtatttattattgacagctcaacactaaccaacctaatttaacacttcgttgggtttccggcgggtaacggtaccgtaaggttcgacccgttccgtacgtaccgacgacccgaaggtccctaccggcccccgttcgtcctacccg

SEQ ID NO: 16972 - DNA, 588 bp, Homo sapiens
  misc_feature: GYAE6OF01EP9TX.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacggttggtcattatgactatgtctcctggtaccaacacttacccaggaccaaacgcccccaaactctatttatttatgatcgtcgctagtccggccctcgtagggtttctaatcgtcttctcgtacggctaccgaagtcgtaggacctaaccgaccggtcccttcccgtcgacctactcctcgtcggcctacccgaggtctaggacgggaccgaggtctaggtatttattagttgcacgtctacactactaactaacctacttaactactcgttggttcggacggtacggacctaggtcgaccgttccgtacgaccgacgacccgtacgtcctcccggcccctgtcctaccg

SEQ ID NO: 16973 - DNA, 700 bp, Homo sapiens
  misc_feature: GYAE6OF01BFSKW.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatcctcctgcactggaaccagcagtgacgttggcattatgactatgtctcctggtaccaacattaccaggcaaacgcccccaaactcattattatgatgtcgctagtcggccctcgtaggggtttctaatcgcttctctggctccaacgtctcggcaaccaccggcccttccccgtagaccctactccgtcgtacggggtccctccgacgggtcctagggaacgggaccgggaacgggtccgttaggtaattttaacgtttagtttcggactacggtacctaccgaacctaactaaaccctaaacccgttaaactttaaaccgtacccgtttacggttttaccggggtttttacccggggaccggggttaacggggtaacccgttaaacgggtttccgtaaccccggtttacccggttaccggtacccgaacggtacccccgaaagggtcccttaaccccggccccccgttccggttcccgttaccccgg

SEQ ID NO: 16974 - DNA, 525 bp, Homo sapiens
  misc_feature: GYAE6OF01D5FBP.34.36.D03.1.454.CMB.1.raw
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggcattatgactatgtctcctggtaccaacattacccaggcaaacgcccccaaactcatttatttatgatgtcgctagtcggccctcgagggtttctaatcgcttctctggctcaagtctggcaacgacggcctcctgcatctctggctccgngctggagacgagctgattattatgcngctcacatacaacattaacactctggtttcggacgggacggaaccgaggttcgacgttaccgtacgtcacgcccgaaggtcctaccgcccccgtcggtcctacccg

SEQ ID NO: 16975 - DNA, 631 bp, Homo sapiens
  misc_feature: GYAE6OF01B8359.34.36.D03.1.454.CMB.1.raw
  modified_base (230)..(230): a, c, t, g, unknown or other
  misc_feature (230)..(230): n is a, c, g, or t
  modified_base (381)..(381): a, c, t, g, unknown or other
  misc_feature (381)..(381): n is a, c, g, or t
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccngcagtgacgttggtcattatgactatgtctcctggtaccaacacttacccaggacaaacgcccccaaactctatttattatgatgtcgctagtccggccctcgtacggggtttactaagtcgtcttctctcggctccaagtctggacaacnccggtcctccctgaccatcctcgtcgggctcgaggcgtaggaggacgagggcttaggtatttagttacttcgacacgtctacaactactaacctaaacctaacttaaacctacgttaccggtttacgggttttccgggacgggtaacggggtaacccttaagggttccggtaacccggttcccgttacggtacccgaacggtaccccgtaaacggtccttacccgtccccccggttcggtcccgtacccg

SEQ ID NO: 16976 - DNA, 589 bp, Homo sapiens
  misc_feature: GYAE6OF01ADODJ.34.36.D03.1.454.CMB.1.raw
  modified_base (446)..(446): a, c, t, g, unknown or other
  misc_feature (446)..(446): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggacaaacgcccccaaactcatttatttatgatgtcgctagtccggccctcgtagggtttctaagtcgtcttctctggctcaagtctggcaacgacggccctccctcgaccatcctcgtcgggcctccgaggtcgtggacggacggaggtctgtatttattattgcngctcaactactaacctaacctattaactacttcgttcgggttttccggcgggtacgggtaccgtaaggttccggtacccgttaccgtaccgtaccgacgaccccgtaacggtcccgtcccgtccccccgttcggtcctacccg

SEQ ID NO: 16977 - DNA, 659 bp, Homo sapiens
  misc_feature: GYAE6OF01ENC8O.34.36.D03.1.454.CMB.1.raw
  modified_base (293)..(293): a, c, t, g, unknown or other
  misc_feature (293)..(293): n is a, c, g, or t
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacgagggtcctgggcccaatctgccctgactcagcctgcctccgtgtcgtgggtctcctggacagtcgattaccatctcctgcactgtaaccgcagtgacgttgatgtattataagtctgtctccgtacggtaccaaaccaaccgaccccgganaaacgcctacccaaactcattacgtatttatgatgtacaataactccggccctagtaggttctttctacatcgtctttctcctcgcccttcagttcgtcgtgacctaaccgcccggtccctacccgtcgtacctactccttaccgtcggtacctaccgaggtcgtacggtaacgggacgggtagggttacgtaagtttacgttacgtcgtaccggtcctactaatacctacttacttccgtactcgtaccctcttcgtacgtacgttggttacggttacggtttacggggaccgggtaaccggtaaaccctaacccggttacccgttacccgttacccttaccggtaccgtacccgggtaccccgg

SEQ ID NO: 16978 - DNA, 564 bp, Homo sapiens
  misc_feature: GYAE6OF01BHIZM.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaactattacccaggcaaacgcccccaaactcattattatgatgtcgctagtcggccctcgagggtttctaatcgcttctctcggctccgaagtctggccaacgaccggcctccctgacctactctcgtgggcctcgaggctagacggacgaggtctgtatttattattgctagctactacataccaactattaacacttcgttcggtttcggacggtacgggtacctaaggttcgacccgttaccgtacgtaccgtacgacccgtaaggccctaccgtcccccgtggtcctacccg

SEQ ID NO: 16979 - DNA, 821 bp, Homo sapiens
  misc_feature: GYAE6OF01EQARW.34.36.D03.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagtacacgtgatcacgaccggtgctcgatttagctgcgtcacgatctctcgttgggggggtctcaggaggcagcgctctcgggacgtctccaccatggcctgggctctgctattcctcaccctctcactcagggcacagggtcctgggcccaatctcgccctgactcagcctgcctccgtgtctgggtctcctggacngtcgattaccatcgtctgcactggaaccngcagtgacgttggcattatgactatgtctcctggtaccaacattacccaggtcaaacgcccccaaactcctattattatgattgtccgtctacgtcggccccttgtacggggtttactaagtcgcctttcgtccttgggccttccgaaacggttcctaggggtacccaaaccgtaccgggtccccttaacccttcggaccctaattcctccgttacggggcccttacccgtaacgggggtccttaccggaagggggtaaccccggtaaggggccgttttacgggtaaccgtttttaagttttacgtttacggtacccgtaagggtacccttaccggttaaacccacctttaaaacccggtaaaacccttaaaccggttttaaaaccccaaccggttttacccgttttaacgggggtttttcccccgggaacgggggttaaccgggggtaaaacccccgttaaggggttttaaccgggacccccggttttaccccggttaaacccggttacccgtaaccgggtaccccccgtaaaacgggttcccgttaaccccgtccccccccgttagggggttccccctttaaaccccggg

SEQ ID NO: 16980 - DNA, 579 bp, Homo sapiens
  misc_feature: GYAE6OF01ARZC5.34.36.D03.1.454.CMB.1.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggacaaacgccccaaactcatgtatttangatgtacaataatccggcctcaggttcgttctcatcgtcttctctcgtcctcatcgtcgtcgcaaccnccggtccctccctgacctattcctcgtcggacctaccgaggctaggacggacggtagggtatatttacttaacgtgcctccgtactacgttaatactacttacgactcgacctactcgtacgtagttgtagttacggtttcgggacggtaaccggtaacctaaaccgttaccgaacccgtttccgttaccgtacgtaacccgg

SEQ ID NO: 16981 - DNA, 716 bp, Homo sapiens
  misc_feature: GYAE6OF01CIAS3.34.36.D03.1.454.CMB.1.raw
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccngcagtgacgttggtcattatgactatgtctctgtaccaactacttaccagacaacgacccccaaactctatttattangtatgtcgctagtccgccctcgtacgggtttctaactcgtcttctcgtggcctctaagtcgtagacaacgccggtccctccctagacccattcgtcgtcgggtcctccgaggtcgtaggaacgggacggtacggtccttagttaactttaagtttacgttacgacctaacggtacctaacctaaacctaaccgttaaaaccctaaaccttaaaccgtttaaaccctaaccgtttccgggttttaaccggggtttttcccgggggaaaccggggttaaaccgggttaacccgttaaacggtttcccgggtaacccccgtttcccggttaaacccgtcccgaaccggtaccccgtaaaccgggtccccgttaccccggaccccccgtttacgggtaccccttaaaccccg

SEQ ID NO: 16982 - DNA, 668 bp, Homo sapiens
  misc_feature: GYAE6OF01DDHLJ.34.36.D03.1.454.CMB.1.raw
tcagtacacgtgatcacgaccggtgctcgatttagctgcgtcacgatctctcgttggggggggtctcagggaggcagcgctctcgggacgtctccaccatggcctgggctctgctattcctcaccctctcactcagggcacagggtcctgggcccaatctgccctgactcagcctgcctccgtgtctgggtctcctggacagtcgattaccatctcctgcactggaaccagtcagtgacgttgtcattatgactatgtctcctgtaaccaacaacttaccaggacaaacgaccccaaactctaattattatgatgtcgctacgtcgccctagtagggtttctaatcgtcttctactcggtctacaacgtctacgggacaacgaccggaccttcccgagtaccatcctcggtcgggtcctccgaggtcgtaaggaaggacgagggtcttaggtaatttacttagttacgctaagtctaactaacgtaacctaaacctaacctaaactttaaaccacgtttacggtttcggggttttaacccggaacgggtaacggggttaaccgtaaacggttaccggtaaccccggtttacccgtaaaccggttaccgaaccggaacccggtaaacggtacccgttccccgtaccccccgtcgggttaccctaacccg

SEQ ID NO: 16983 - DNA, 749 bp, Homo sapiens
  misc_feature: GYAE6OF01D7QLI.34.36.D03.1.454.CMB.1.raw
  modified_base (221)..(221): a, c, t, g, unknown or other
  misc_feature (221)..(221): n is a, c, g, or t
  modified_base (523)..(523): a, c, t, g, unknown or other
  misc_feature (523)..(523): n is a, c, g, or t
tcagtacacgtgatcacgaccggtgctcgatttagctgcgtcacgatctctcgttgggggggggtctcaggaggcagcgctctcgggacgtctccaccatggcctgggctctgctattcctcaccctcctcactcacgggcacgagggtcctgggcccaatctgccctgactcagcctgcctccgtgtctgggtctctggcagtcattaccatctcctgcnctacggaccagctagtcgtacgttggtactattatgtacttatcgtctcctacggtacctaactactaccgacgaaccaaacccgaccccctaaatcctaattttattaagtacgtatcgttaccgtcgtaccggttccggacccttacgggtagggttttacctaactcgttacttctcgtacggtcctacggtaacgttcgacggtaccaaccgtacccgtccctcctacgtacctacgttccgtccggttaggacccttccggtagggaccgtacggggaacggaccggttaacgggtntttaacggttaattttacgttacgttacggtaccgtacgtccttaaaccaacgttaaactaaccctaaacttaacccgttaactaccgtttcgggttacggttacccgggggtacgttaaaccgggaccggttaacggttaacccgtaccgttacccggtaaccgaccgacggtaaccccgtaacggtcccgtccccggttccccgtaacccggtccgttaccccg

SEQ ID NO: 16984 - DNA, 857 bp, Homo sapiens
  misc_feature: GYAE6OF01C3WNR.34.36.D03.1.454.CMB.1.raw
tcagtacacgtgatcacgaccggtgctcgatttagctgcgtcacgatctctcgttggggggggtctcaggaggcagcgctctcgggacgtctccaccatggcctgggctctgctattcctcaccctcctcactcagggcacgagggtcctgggcccaatctcgccctgactcagcctgcctccgtgtcgtgggtcctccgtggactagtcgacttaccatcctcctgacctacgtacggaaccagtccgtaaggttcggtacggtttcggtacttaagtttaacttcggtaacctttacgttcggttaccttcccggttaccggtaaaccctaaaccgtaaccgtttaacccgaagggaacccctaaaacccggtacccccctaaaactttacctaactttttaatttaaccgtaggtacgtttacggttaccgtacgtttaaccggttcccggtaccccgtttacgggtttaaccgggggttttaccttaaacgtttccgttcccgttttaccgttaccggttccggttacccgtaacccgttaacgggtttccgtacgggtacccgtaaaccgtccccggttaccttcccgtacgtacctaccttaccggtcggttaccgggtaccttccggacggttacgttacgggaacgggtacggacgggttcgttaacgtttaatttacgtttagttacgtacgtacctacgttaaccaacgttaacctaaaccgtaactacttaaaccgttccgtttggtaccgggtttacggacgggtaacgtacgtacggtccgtacccgtcgttaaccggctacccgaccggtacccgtaccgtcccgtcccgtcgtccttacccg

SEQ ID NO: 16985 - DNA, 776 bp, Homo sapiens
  misc_feature: GYAE6OF01AZ2AV.34.36.D03.1.454.CMB.1.raw
tcagtacacgtgatcacgaccggtgctcgatttagctgcgtcacgatctcgtcttgggggggggtctcaggaggcagcgctctcgggacgtctccaccatggcctgggctctgctattcctcaccctcctcactcagggcacagggtcctgggcccaatctgccctgactcagcctgcctccgtgtcgtgggtctcctggacagtcgattaccatcctcctgcacgtcggaaccagcagtgacggtttggactattatagtacttatcgtcctccgtaggtaacccaacgtacttacccgaggaccaaacccgtcccccaaacttctaattttaatttatagtagttcgtccgtaccgttacggttcccggtacccgttacggtaacggggtttttactaacgttccgttcctttcgttccgtcggtccctaccgtaacggtccgtacggacctaaccgacccggtcccttacccgtacgtaccctacttcgtccgtcggggtccctaccggacggtccgtaggacgggaccggacggtacgttagtaatttacgtttacgtcgtacgtacgtacctaccgtaactacgtaaaccctaacctaactttaaccgtaccgtttccgggtttacgggtttacccgggacggggtaaacccgggttaacccgttaagggtttcccggtaccccggttacccgttacccggtaccggtaacccgtaccccggtaacggttacccctcccgggtaccccccgttaccggtccgttacccccg

SEQ ID NO: 16986 - DNA, 843 bp, Homo sapiens
  misc_feature: GYAE6OF01D62NB.34.36.D03.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacgtcggtcgtcgggcctagtcgtcgtcctgtactcgaggtctcgtccgtcgtgtcgtcggtctcgngactagtcactaccactactcctcctgcctacgtacggtaaccgngtaggtacggtacgttagagtagttaatttaacgtacgtcgtttcgtacccttaccggtaaccggaaacccaaacccgaacccccggaccccggaaataaaccgtcccctaaaccccctaaaattcgttaagttagtttaattttacggacgtaggttactaaacgtaaaacgttacccgtcccggtacccttaggttacgggttttcctttacccagttaccgttcctcctttccgtccgtcctaaccctcgtagttcgtacgtacggaaccctaccggtcccgtcccctacgtaccgtacctcgttccgttcgtacggtacccgtacggtacgggtaccgtagggaacgggtacgggtaggtttacgttaaccttttaacgtcggtccgtaccgtacccttaagtaccgttaaccttaacgttcccgttaaccgtaccgtaccctaccttaaccgttccggtacgttacgggtttaggtttaacccgggttttaccgggttaccgggggaacccgggttaaacccgaaaaccccgtttcccgaccccggtttaaccccggtttccgttaacccggccggtaaacccccggg

SEQ ID NO: 16987 - DNA, 801 bp, Homo sapiens
  misc_feature: GYAE6OF01ECE3Z.34.36.D03.1.454.CMB.1.raw
tcagtacacgtgatcacgaccggtgctcgatttagctgcgtcacgatctctcgttggggggggtctcaggaggcagcgctctcgggacgtctccaccatggcctgggctctgctattcctcaccctcctcactcagggcacagggtcctgggcccaatctcgccctgactcagcctgcctccgtgtcgtgggtctcctggacagtcgattaccattcctcctgcacgtaggaaccagcagtgtacggttggtctattatagacttatcgtctccgtacggtaaccaactacttacccgagaccaaaccgaccccctaaactactaatttaatttagtagtacttcgtcgtacgtacggttcccggtacccgttcggttacgggttttacctaacgttccgttccgtttccttccgtcggtaccctaccgtaaacggttccgtacggaacccgtaaaccgtaccccggtccccttacccgtacgtaacccttacgttcccgttccggtccggggtacccttaccgggacgggtacgtacgggtaacggggaaccggtacgggttccgttaaggtttaactttaacgttttcgttacgttaccggttacgttttacccgtttagaaccgtaccggtaccgtacggtaccgttaggtacgttacgttacgtttaagttccggttaccggttaaccgggtaacgggttaccggggtaaacccgtacgggttccccgtacccggttaccgtaaccggtacccgaacccggtaacccccggaacccggaacccccgtaacccgtccg

SEQ ID NO: 16988 - DNA, 774 bp, Homo sapiens
  misc_feature: GYAE6OF01CH8E7.34.36.D03.1.454.CMB.1.raw
  modified_base (205)..(205): a, c, t, g, unknown or other
  misc_feature (205)..(205): n is a, c, g, or t
tcagtacacgtgatcacgaccggtgctcgatttagctgcgtcacgatctctcgttggggggggtctcaggaggcagcgctctcgggacgtctccaccatggcctgggctctgctattcctcaccctcctcactcagggcacagggtcctgggcccaatctcgccctgactcagcctgcctccgtgtcgtcgggtctccgtggacngtcgacttaccatcctcctgcacgtggaaccagctagtgtacgttgtctattatgactagtgttcctccgtacggtaaccaacacttacccgaggtaccaaacgcccccaaaactctaattactttatgtatgtcgtactaggtccgtcccgtcggtacgggtttactaacgttcgtacgttcttcgtcggtacctacctaacggtcgtcggtaccgtaaaccgtccggtccccttccccgtacgtaacccgtacgttaccgttccggttaccggggtccctacccggacggtccgttaacgggtaaccgggacggtacgggtaccttaggttaacttttaagtttacgtttcgaccgtagttaccctcgtaaaccaaaccttaaccgtaaaccctaaacgtttaacctaaccggtttccggtttacgggttttaccgggaccgggtaacggggtaaacccgtaacgggtttaccgtaaccccggttacccgttaaccggtaccgaaccggtaccccggtaacgtaccccgggttcccgttccccccgttcggtcccgttaacccccgg

SEQ ID NO: 16989 - DNA, 688 bp, Homo sapiens
  misc_feature: GYAE6OF01BDOWK.34.36.D03.1.454.CMB.1.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
tcagtacacgtgatcacgaccggtgctcgatttagctgcgtcacgatctctcgttggggggggtctcaggaggcagcgctctcgggacgtctccaccatggcctgggctctgctattcctcaccctcctcactcgagggcacgagggtcctgggcccagtctgccctgactcaggctgcctccgtgtctgggtctccgtggacagtcgatcaccatctcctgcactgtaaccgntagtgtacgttgatgattatagtctgtctcgtacggtaaccaacaccgacccganaacgcctaccaatcatgtattngatagtacaagtacgtccggcctagtaggttcttcctactacgtccgtcttcctctccgtacctctagtcgtccgtacggacctaacccgtcccggtcccctaccgtaccgtaccctacgttaccttcccggtaccggtaccctccggaggtacgtagggtaaccggtacgggtaggttacgtttaacgtttacgttaccgtacggcccttaccgtactaaacgtttactaccgttacttaaccgaccgttccgacccttacttccgtacgtacgtttgggttaccgtttacggggtttcccgggaaccgggtaaacccggtaaccccttaacccgtaccccggttaccgtttaccccgttccgtaacgtaccccgg

SEQ ID NO: 16990 - DNA, 595 bp, Homo sapiens
  misc_feature: GYAE6OF01B3T20.34.36.D03.1.454.CMB.1.raw
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttgtcattatgactatgtctctggtaccaacattacccaggacaaacgcccccaaactctattatttactgatgtcgctagtcgccctcgtagggtttctaatcgtcttctcgtgctcagtctggcacncggcctccngacctatctcgtgggctccgagcgtagacggacgacggctagtatttattagtcgacagtctacgactaacgtaccaaacctaattaaccacttcgttcggttttaccgggacgggtacgggtaaccctaaggtttccggaacccgtttaccggtaccgtccgaaccggaccccgaaacgggtcccttcccggaccccccgttcgggtcccttacccgg

SEQ ID NO: 16991 - DNA, 695 bp, Homo sapiens
  misc_feature: GYAE6OF01AK3XI.34.36.D03.1.454.CMB.1.raw
  modified_base (129)..(129): a, c, t, g, unknown or other
  misc_feature (129)..(129): n is a, c, g, or t
  modified_base (234)..(234): a, c, t, g, unknown or other
  misc_feature (234)..(234): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctnactcagggcacagggtcctgggacccaatctgccctgactcagcctgcctccgtgtctgggtcctccgtggactagtcgattaccatctcctgcacgtggaaccngcagtgacgttgtcattatgactatcgtctccgtggtaccaactacttacccacggtacaaaccgaccccctaaactactaactttaatttacgtagtatcggtcgtacgttacggtcccggtacccgtcggttaacgggttttactaacgtcgttccttacttccggcggtacctaccgtaacgttcgtacggacctaaaccgtcggtcccctacccgtacggtaacctacgttcgtcccggttcggggtacccttacccggtaagggtcccgttagggaaacggggtacccggtaggttccgttaacgttaagttttaacttgtcgtacgacgtcctacgaacctaataccgtaactacttactacttcggtgggtttacgacgggtacgaccgttaaggtcctaccgtacgtcgtaccgacgacccggtagtaccgtcccgacccgttgccttacccg

SEQ ID NO: 16992 - DNA, 937 bp, Homo sapiens
  misc_feature: GYAE6OF01C6T1I.34.36.D03.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
tcagtacacgtgatcacgaccggtgctcgatttagctgcgtcacgatctctcgttggggggggtctcaggaggcagcgctctcgggacgtctccaccatggcctgggctctgctacttcctcaccctcctcactcagggcacagggtcctgggcccaatctcgccctgactcacgcctcgcctccgtgtctgggtcctccgtggacngtccgaattaccattccgtcctgcctacgtacggaaccngactagtaggtacgttggtactattagtacgtacttagtnttcctccgttacggtaaaccctaactaaccgttaacccgaacggtaacctaaaacccgaacccccgtaaaacttactaattttaactttagtacgtacgttcgttccgacgtttaccggtcccgtacccttacgggttaacgggttttcctacgtacgtttccgtaccgttttcgtccgttccgtccgttacctaacgtttcgtccgttacggaacctaaacccggtcccgtccctttacccgaccggtaaccttccgttccgttaccggtacggtaaccctccggtaacgggtacggttacggggaacggtaacggggttacgggttaacgtttaacgttttaacgtttacccggcgggtaccccgttaccgttaaacctttaacgttaaacccgtttaacttaccctttacccgtaacccgttacccgtaccccgttaacgtttaccccgttaaggggttacttttacggggtttaaccgggtttaaccggggttttttacccgggggggaaacccggggtaaaaaccccgggtttaacccccgttaaaaccccgggttttacccccgggttaaaccccggtttttccccggtttaacccgggtaacccggtacccccgggttaaaacccgggtttaaccccccggggg

SEQ ID NO: 16993 - DNA, 740 bp, Homo sapiens
  misc_feature: GYAE6OF01AYRXV.34.36.D03.1.454.CMB.1.raw
tcagtacacgtgatcacgaccggtgctcgatttagctgcgtcacgatctctcgttgggggggggtctcaggaggcagcgctctcggggacgtctccaccatggcctgggctctgctattcctcaccctcctcactcagggcacaggggtcctgggcccaatctgccctgactcagcctgcctccgtgtctgggtctccgtggacagtcgattaccatctcctgcactcggaaccagcgtagtgacgttgtactattatgactatgtctccgtaggtaccaactacttacccgaggtaccaaaccgacccccgtaaacctactattaatttatgtagtcgtcgtaccgtacggtccggtccctacggtaggggtttactaagtccgtctttcgtcgtacggtctaccgtaacgttcgacggtaccgtaaccgtacccggaccccttcccgtaccgaccctacgttaccgtcggttcgggtccctaccggtacgggtccgtagggaacgggaacggacggggtactaggttaacgttttaagttattacggctacggtcctacaaccttaacgtaaacctaaaccctaacgttaacttacccgttacggtttcggggtttccgggacgggtaaccgggttaaccgtaacggttccggtacccgtacccggtaaccgttccgaacccggtacccgtaacgggtacccgtccccggttacccccggtccgttcccgtaaccccg

SEQ ID NO: 16994 - DNA, 222 bp, Homo sapiens
  misc_feature: GYAE6OF01DCG69.34.36.D03.1.454.CMB.1.raw
  modified_base (148)..(148): a, c, t, g, unknown or other
  misc_feature (148)..(148): n is a, c, g, or t
  modified_base (208)..(222): a, c, t, g, unknown or other
  misc_feature (208)..(222): n is a, c, g, or t
tcagtacacgtgatcacgaccggtgctcgatttagctgcgtcacgatctctcgttggggggtctcgaggaggcagcgctctcgggacgtctccaccatggcctgggctctgctattcctcaccctctcactcgaggcacgaggttccncgggaccaatcgtcggtcctgacctcgagccctgtccctcgtgtcgtcggtcctcgtacnnnnnnnnnnnnnnn

SEQ ID NO: 16995 - DNA, 517 bp, Homo sapiens
  misc_feature: GYAE6OF02ICQYS.34.36.D03.1.454.CMB.1.raw
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
tcagtacacgtgatcacgaccggtgctcgatttagctgcgtcacgatctctcttgggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaagccccccaaaactcattattatgatgtcgctagtcggccctctaggggtttctaatcgcttctctggctcaagtctggcaacncggcctcctgaccatctctcgggctccaggctggaggacgaggcttgattattattgcagctcacataccaaccattaacactntggtttcgnggaggacctaggttcgaccgtctacgtcagcccaaggcctcgcccctcggtctaccg

SEQ ID NO: 16996 - DNA, 685 bp, Homo sapiens
  misc_feature: GYAE6OF02I40N4.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcaggtgtacgttgtcattatgactatgtctctggtaccaactacttacccgaggacaaaccgacccccaaactctatttaatttactgtatgtcgtctacgtccggtccctacggtaggggtttactaacgttcgtcttctcgtcgtcctaccaacgttcgtcggaccaaaccgaccggtcccttcccctacgaaccctattcccgtttccggtcgggtccctaccgagggtccgttaggggaacgggaaccgggtacgggtccgttagtaacgttttaagtttagttcgtacaggtcctaccaactactaaccaaccttaacttaaaccgtacttccgtttacggggttttcgggacgggtacgggtaacccgtaaggttaccggtacccgttaccgttaccgtacgaccgtacccgaacggtcccttacccggccccgttcggtacttacccg

SEQ ID NO: 16997 - DNA, 515 bp, Homo sapiens
  misc_feature: GYAE6OF02FVY8H.34.36.D03.1.454.CMB.1.raw
tcagtacacgtgatcacgaccggtgctcgatttagctgcgtcacgatctctcttgggggggtctcaggaggcagcactctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaagcccccaaactcattatttatgatgtcgctagtcggccctgaggggtttctaatcgcttctctggctcaagtctggcaacacggcctccctgaccatctctgggctccaggctgaggacgaggctgatttattattgcagctcacatacaaccattaacactcttggttttcggcggtaggaccaagttgaccgttcctacgtcagccaaggctcgccccctcggctaccg

SEQ ID NO: 16998 - DNA, 521 bp, Homo sapiens
  misc_feature: GYAE6OF02G3SGI.34.36.D03.1.454.CMB.1.raw
  modified_base (369)..(369): a, c, t, g, unknown or other
  misc_feature (369)..(369): n is a, c, g, or t
  modified_base (441)..(441): a, c, t, g, unknown or other
  misc_feature (441)..(441): n is a, c, g, or t
tcagtacacgtgatcacgaccggtgctcgatttagctgcgtcacgatctctcttgggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaacgccccaaactcattattatgatgtcgctagtcgccctcgaggggtttctaatcgcttctctggctcagtctgcacacgcctccngaccatctcgtgggctccgagctgaggacgaggctgattattattgcagctcacataaccaacctattaacnctcttggtttcggcggtacggaccgtaaggttcgacccgtcgtacgtcagcccaaggcctaccgcccctcggtcctaccg

SEQ ID NO: 16999 - DNA, 529 bp, Homo sapiens
  misc_feature: GYAE6OF02IIGAR.34.36.D03.1.454.CMB.1.raw
  modified_base (270)..(270): a, c, t, g, unknown or other
  misc_feature (270)..(270): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggcattatgactatgtctcctggtaccaanattacccaggcaaagcccccaaactcatttattatgatgtcgctagtcggccctcaggggttttcaatcgcttctctggctcaagtctgcacncggcctcccngaccatctctgggctccaggctggaggacgaggcctgattattattgcagctcactactacaaccattaacacttcttggttttcggcggagggaccctaaggttcgaccgtcctaacgtccagacccaaggcctcggaccccctcggtcctaccg

SEQ ID NO: 17000 - DNA, 572 bp, Homo sapiens
  misc_feature: GYAE6OF02HQKBJ.34.36.D03.1.454.CMB.1.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggccaaaacgccccccaaaactcactgactttangatgtacaaataatcggccctcaggttcgtttcncatcgctttctctgcctcatgtctaggacaactaccggcctccctcgacctactctcgtcggactccgaggtctaggacggtacggagggttacgtagttattaccgtagccgtacctacgtatacttactacttacactgaccctactctcgtagtcggtagtacgttttccggacggtacggacctaacgtccgtacccggtttccgttaccgtcgtaaccgg

SEQ ID NO: 17001 - DNA, 659 bp, Homo sapiens
  misc_feature: GYAE6OF02IQRM6.34.36.D03.1.454.CMB.1.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactggtaaccggcagtgacgttgatgattataagtctgtctcctaggtaccaaacaaccaccccgganaaacgcctacccaaactcatgtatttangattagtacaaataactccggaccctcgtaggttcgtttcctctactcgtcttctctcgtcctctattcgtctacggaccaactcgtccggccctacctacgacctacttccttacgtcgggtacctacccggtacggtcgtaggaacgggaccggtacggggtaccaaccggaccccgtaagggtccccttacccggtcccccggttacggtcccgtaaccctttccgttcccggttcccccgcccttaccctccctacgttacccgtaccggttcgttaaccgtgggtaaccggtccgggtcgtacgggaaccggtaaccgggccgtaacgtacggtagacg

SEQ ID NO: 17002 - DNA, 537 bp, Homo sapiens
  misc_feature: GYAE6OF02HTBEO.34.36.D03.1.454.CMB.1.raw
  modified_base (367)..(367): a, c, t, g, unknown or other
  misc_feature (367)..(367): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaaacgcccccaaactcattattatgatgtcgctagtcggccctcaggggtttctaatcgcttctctgcctcatgtctggcaacnccgcctccctgaccatctctgacctcagctgaggacgagggtgtattattacgtgcncctnatatacattccacttgccctactctacgtatcgtgtacgttttcgggcggtaacgggaaccctaaacgtccgtacccgttccgttccgtacaccgtcccgaaggtcccg

SEQ ID NO: 17003 - DNA, 527 bp, Homo sapiens
  misc_feature: GYAE6OF02IQNZ9.34.36.D03.1.454.CMB.1.raw
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagtacacgtgatcacgaccggtgctcgatttagctgcgtcacgatctctcttgggggggtcgtcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggacaaacgccccaaactcattatttatgatgtcgntagtccgccctgagggttctaatcgcttactctggacttccgagttctggacaacacggccttacccngacactctctgggctccagctgaggacgnggctgattatatgcngcntacgatacaacgataaccatctggtttcgacggacgtaccaaggtttcgaccgtacctacgttcacgacccgagcgtcccgcccttcggtcctaccg

SEQ ID NO: 17004 - DNA, 541 bp, Homo sapiens
  misc_feature: GYAE6OF02HHZDR.34.36.D03.1.454.CMB.1.raw
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (540)..(540): a, c, t, g, unknown or other
  misc_feature (540)..(540): n is a, c, g, or t
tcagtacacgtgatcacgaccggtgctcgatttagctgcgtcacgatctctcttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaanaacacccggnaaagctccaaactcatgatttangactgtcaataatcggccctnaggttgtttcncatcgcttctctgccctcatgtctcggactaacacggcctcctgacctatctctggactccaggtcctagacggacgagggtcacgcccgaaggcctacgccccgtacggtcctaaccttccgtcgttccccggccctcctacacttccgaccgttgtaacctcggacggtccggcgtcggccaacgggccgtacgagttacgcnc

SEQ ID NO: 17005 - DNA, 538 bp, Homo sapiens
  misc_feature: GYAE6OF02F5ZMG.34.36.D03.1.454.CMB.1.raw
  modified_base (459)..(459): a, c, t, g, unknown or other
  misc_feature (459)..(459): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactggaaccatcactgacgttggtggttatgggtatgtctcctggtaccgacaatacacagacagacgccccccaactcttaatttttgatgtcactaatcggccctcaggggtttctcatcgcttctctggcctccaagtctggcagcaccggcctccctgaccatctcgtgggcctccgaggctggaggacgaggcttatttacctacgtgctgctcatatactatttcgccagtccncttgtcgtagtttcggcgggtacgggaccaagggtcgaaccgtccgtcgagtcacggcccgaacggcctcgtccccccg

SEQ ID NO: 17006 - DNA, 616 bp, Homo sapiens
  misc_feature: GYAE6OF02GZQB4.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacacttaccaggacaaacgacccccaaactcaattatttatgatgtcgctagtcggccctcgtagggtttctaatcgtcttctctgctcaagtctgcaacacggccctcctgaccatcctcgtcgggcctccgaggctggacggacggaggcgtagtattattagttgacagtctacactactaaccaacctaacttaacaccgttcgttacgggttttccgggacgggtacggggtaaccgtaaggttaccggtaacccggttacccgtaaccggttaccgtaaccggtaccccgtaacgggtcccgttacccgggtaccccccgttacgggtaccctaaccccgg

SEQ ID NO: 17007 - DNA, 548 bp, Homo sapiens
  misc_feature: GYAE6OF02G6RH4.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaacgcccccaaactcattatttatgatgtcgctagtcggccctcgaggggtttctaatcgcttctctggctcaagtctgcacacggcctcctgaccatctcgtggctccgagctgaggacgaggctgtattattactgtcagttctttgactagcagcctgagtcgtactttatcgttcgttacggaacgttcggggaaccctaacgggtcctacccggttaccgtacgggtccacgaccccgaacggaccccaaccccgtaccg

SEQ ID NO: 17008 - DNA, 523 bp, Homo sapiens
  misc_feature: GYAE6OF02FVG1K.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatcctcctgcactggaaccagcagtgacgttggtcattatgactatgtctcctggtaccaacattacccaggcaaagcccccaaactcattatttatgatgtcgctagtcgccctcaggggtttctaatcgcttctctggctcaagtctggcaacacggccctccctgaccatctctgggctccaggctgaggcgagctgattattattgcagctcacatacaacattaacactctggtttcgcggtagggaccaaggttcgaccgttcctacgtcgagcccgtaaggcctacgcccccttcggtcctacccg

SEQ ID NO: 17009 - DNA, 762 bp, Homo sapiens
  misc_feature: GYAE6OF02JB0PB.34.36.D03.1.454.CMB.1.raw
  modified_base (307)..(307): a, c, t, g, unknown or other
  misc_feature (307)..(307): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaactattaccgaggcaaacgccccaaactcattatttangatgtcgctagtccgcctcgtagggtttctaatcgtcttctacgtggtcctcacgtcgtgactaacgaccggtcccttcccgtacgtacctactccgttacgtcggggtaccctcccgtaagggtccttacgggaacgggtaaccggtacgggtccgttacggtaattttaacgtttagttcgtaccgtaacggtccttaaccgaacctaaccgttaacctaaaaccccgttaagtttaaaacccgtaccggtttacccgtttacggggtttttaacccgggaccgggggttaaaccggggttaacccgttaaacgggttttacgggtaacccccggtttaacccgtttaaacccgggttaccgtaaaccccggttaacccccggttaaacggggttaccccgttaccccgggttaaccccccccggtttacgggttacccccgttaaccccggg

SEQ ID NO: 17010 - DNA, 604 bp, Homo sapiens
  misc_feature: GYAE6OF02H1OSK.34.36.D03.1.454.CMB.1.raw
  modified_base (373)..(373): a, c, t, g, unknown or other
  misc_feature (373)..(373): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaacgcccccaaactcctaattatttatgtatgtcgcttacggtccggccctcgaggggttttcaatcgtcttctctgctcagtctgcacncggcctcctgaccatctcgtcgggctccaggtctgaggacgaggtctgtatttattattgcacgtctcaacgtactaaccaaacctaactttaaccacgttacgttcgggttttaccgggccgggtacgggtaacccgtaaggtttcggtaaccccggttccgtaaccgtacccgaacggtaccccgaacgggtacccgttcccggccccccgttacggtacccttacccg

SEQ ID NO: 17011 - DNA, 768 bp, Homo sapiens
  misc_feature: GYAE6OF02HK1LF.34.36.D03.1.454.CMB.1.raw
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacgagggtcctcgggcccagtctcgccctgactcaggctcgcctccgtgtctgggtctccgtggacagtcgactccaccatctcctgcactacgtaccgctagtgacgttgatgtattataacgtctcgtccttccgtacggtaaccaaccaacccgacccgacctaaacgcctaccctaaactcattgtactttagtagtatcgtaactaaactaacggtccccggtaccctacggttagttcgttttaccactacttcgtccttcctcgttccnccttacgtntacgttccgtacggacctaacccgacccggtcccttacccgtacgtaccctactttccgtccgtacggtaccctaccggacggtccgggtacgggtaacggggtaaccgggttacggggttaaatttaaccgggttttaacttaccggtacccgggtacccgtttacccgtaaactacttaaaccgttaactttaaccctttaaccgcccggtttaccaccccgttattaccgtggttaacttgggttaacggttttacgggttaacccggggaccgggtaaccgtaaacccttaaccggttcccgttacccggtttaacccgttcggaacccggttaccccgg

SEQ ID NO: 17012 - DNA, 702 bp, Homo sapiens
  misc_feature: GYAE6OF02IXEVB.34.36.D03.1.454.CMB.1.raw
  modified_base (327)..(327): a, c, t, g, unknown or other
  misc_feature (327)..(327): n is a, c, g, or t
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacgagggtccgtgggcccaatctcgccctgacctcacgcctgcctccgtgtcgtgggtctcctggactagtcgatccaccatctcctgctactcggtaccggctagtgtacgtgatgtattatacgtctcgtctccgtacgtaccaacaaccacccggacaacgcctaccaactcagtagttatttanagtatgtacaacgttaacgtcccggtccctacgttacggtttctttaccgtactacttccgtcctttcgtccgtcgttccttcctaagttcgtcggtacccggtaccgaacccgtacccggtccccttaccccgtacgtacctacgttaccgttacggtcggtacctaccgggaacggtcggtaggtacgggtaacgggtagggttacttaacgtttacttacggtagtaccgtctacgtaattaccgttactacttaccgtcgacctctaccgttacgtcgtaggttcgttaggttacggttaccgggaaccggttaaccggaaccttacccggtacccggttacccgtttccggttacccggacgtaacccgg

SEQ ID NO: 17013 - DNA, 571 bp, Homo sapiens
  misc_feature: GYAE6OF02GU1FD.34.36.D03.1.454.CMB.1.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccngcagtgacgttggtcattatgactatgtctcctggtaccaacaaccaccccggacaaagcctacccaaactcatgatttangatgtacaataactcggccctcgaggttnttctcatcgtcttctctcgcctcatcgtctcggacaacgaccggccctcccgtcgacctactctcgtcgactccgacgcgtaggaggacgtaggtcacgtacccgaggtcctccggcccctcggtctaccgttccgttccgttccccgcccttacctcctacgtacctacgttaccgtaccgtacggtcggccggtcgtcggaccggtacgggccgtacgtacgtacgagtc

SEQ ID NO: 17014 - DNA, 657 bp, Homo sapiens
  misc_feature: GYAE6OF02FIWUK.34.36.D03.1.454.CMB.1.raw
  modified_base (250)..(250): a, c, t, g, unknown or other
  misc_feature (250)..(250): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatcctcctgcactggaaccagcagtgacgttggtcattangactatgtctcctggtaccaactattacccaggacaacgccccaaactcatttattatgatgtcgctagtccggtcctcgtaggggtttctaatcgtcttctctcggctccaagtctggacaaccgccggccctccctcgacctatctcgtcgggccgtccgggctaggaggtatggacggtctagtactttacgttacctgttccgtacgttccgtttagaccgtacgctaacgtcccgttaggacgttcgtactttacgttcggttaccgttacggggtaaccgttacgggggtaaccctaaaccggggttacccgttaaccccgggttacccgttaaccggggtacccgtaacccgggtaacccccggaaacccgggtacccccgtaaacccccgttaacccgg

SEQ ID NO: 17015 - DNA, 580 bp, Homo sapiens
  misc_feature: GYAE6OF02GJ9NC.34.36.D03.1.454.CMB.1.raw
  modified_base (120)..(120): a, c, t, g, unknown or other
  misc_feature (120)..(120): n is a, c, g, or t
  modified_base (229)..(229): a, c, t, g, unknown or other
  misc_feature (229)..(229): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (580)..(580): a, c, t, g, unknown or other
  misc_feature (580)..(580): n is a, c, g, or t
tcagtacacgtgatcacgaccggtgctcgatttagctgcgtcacgatctctcttgggggggggtctcaggaggcagcgctctcgggacgtctccaccatggcctgggctctgctattccncaccctcctcactcagggcacgagggtcctgggacccaatctgccctgactcagccctgcctccgtgtcgtgggtcctcctaggacacggtcacttaccatccttccgngacactagggaacccagtcaaggtcgtaaccgttggaccaatttatacgaactattcgtcctaccgttacggtaaccaaacgaaccacccccgggataaacgcctacccaaacgtcaatgtaattangtangtacaataacncggcctacgaggttnttacncagtctcttcgtctcgctacntcgtnggacaacgcgtcctcctagctatctctacgctccgagtcagaggaccggtagccagacccgagggtccctccgggccccttacggtcctagttaccgttccgtcccctccgtcctacacgtcgtacgtctagacggcgtcggactgacgacgtcgatatacgn

SEQ ID NO: 17016 - DNA, 770 bp, Homo sapiens
  misc_feature: GYAE6OF02FWEHK.34.36.D03.1.454.CMB.1.raw
tcagtacacgtgatcacgaccggtgctcgatttagctgcgtcacgatctctcttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttgtcattatgactatgtctcctacggtaccaactacttacccgaggaccaaaccgacccccaaactctattacttatgatgtcgacgtgtcccggcctcgtaggggtttctaacgttccgtcttcgtctcggtcctaccgtaacggtctacgggaaccaaccgtacccgggtcccttacccgtacgtaaccctacgtttacccgttccggtcggggtcccgtacccggtacgggtaccgttaggggaaccgggtaaccgggacgggtaccgttaggtaacgtttttaagtttacgttcggtacgtacggttaccgtaaccgtaacgtaacgtaaacccttaaaccttaacgtttaaaccttaccgtttaccggtttacggggtttttacccggggaaccggggttaacggggaacccgttaaacgggttccggtaaacccggttcccgttaaccggttaccgtaaccggtacccggtaacggttacccggttaccccggtcccccggttaccggttacccgttaaccccgg

SEQ ID NO: 17017 - DNA, 710 bp, Homo sapiens
  misc_feature: GYAE6OF02GKYVQ.34.36.D03.1.454.CMB.1.raw
  modified_base (120)..(120): a, c, t, g, unknown or other
  misc_feature (120)..(120): n is a, c, g, or t
  modified_base (582)..(582): a, c, t, g, unknown or other
  misc_feature (582)..(582): n is a, c, g, or t
tcagtacacgtgatcacgaccggtgctcgatttagctgcgtcacgatctctcttgggggggtcgtcaggaggcagcgctcgtcgggacgtctccaccatggcctgggctctgctattccncaccctcctcactcgagggcacgaggtcctgggcccaatctcgccctgactcagcctgcctccgtgtctgggttctcctggacaggtcgattaccatcctcctgcacgtggaaccagcaggtgaccgttgtacattatgactatcgtctccgttggtaaccctaactacgttaacccagggaaccaaaaccgaccccccaaactacctaatttagtttatcgaattcgtcgctaggtccgtccgtcgttaggggtttacaatccgtacttctgtacgtcctaccaacggttcgtacgccgaaaccgccggtcccttacccctagacccgtaacttccgttccgttcgggacccgttaccgcgggtctacgggtaacggaccggtaggtccgtagtagtttaacgtttagtacggtcaccgtcgttaccaacgttaacctaacaaacccgtaacgtttaaacnccgtttaaaccggtttcgttttaccgggacgggttaccgggtaacctaacgggttaacggcccgttaccgttaaccgtcgtaaccgcccgtagggccgttaccccgtcccggtaccggtcctaacccg

SEQ ID NO: 17018 - DNA, 677 bp, Homo sapiens
  misc_feature: GYAE6OF02HO7FD.34.36.D03.1.454.CMB.1.raw
  modified_base (530)..(530): a, c, t, g, unknown or other
  misc_feature (530)..(530): n is a, c, g, or t
tcagtacacgtgatcacgaccggtgctcgatttagctgcgtcacgatctctcttgggggggggtctcaggaggcagcgctctcgggacgtctccaccatggcctggctctgctattcctcacctcctcactcagggcacgagggtcctgggcccaatctcgccctgactcagcctgcctcgtgtctcgggtctccgtggacagtcgattaccatctcctgacacgtacggaaccagctaggtcgtacgttgtactattatcgtactacgtgttcctccgtcggtaaccaactacttaccgagaccaaaccgaccccaaactctaatttattatagtagtcgtcgtcgtacggtccgaccgttggtacgggtttactagtccgtcttcgtcgtcggtcctaacgtaacgtcgtcggaacctaacgtaccgtccctaccgtacgaaccctacgttacccgttacggtccgggtaccttccgggacggtcgtaaggggacggtaacggacggtcttaggttatttaagttacncgactacgctactactacgtaaccaacttactaacctcgttcggttacgggttccggacgggtacgtaacgttacggtacgtacccgttacgtaccgtaccgacgtaccgtacggtcccgtacccgtacccgttccgacttacccgg

SEQ ID NO: 17019 - DNA, 669 bp, Homo sapiens
  misc_feature: GYAE6OF02H5ETJ.34.36.D03.1.454.CMB.1.raw
  modified_base (129)..(129): a, c, t, g, unknown or other
  misc_feature (129)..(129): n is a, c, g, or t
  modified_base (133)..(133): a, c, t, g, unknown or other
  misc_feature (133)..(133): n is a, c, g, or t
  modified_base (141)..(141): a, c, t, g, unknown or other
  misc_feature (141)..(141): n is a, c, g, or t
  modified_base (202)..(202): a, c, t, g, unknown or other
  misc_feature (202)..(202): n is a, c, g, or t
  modified_base (470)..(470): a, c, t, g, unknown or other
  misc_feature (470)..(470): n is a, c, g, or t
tcagtacacgtgatcacgaccggtgctcgatttagctgcgtcacgatctctcttggggggggtctcaggaggcagcgctctcgggacgtctccaccatggcctgggctctgctattcctcaccctcctnactnagggcacngggtcctgggacccaatctcgccctgactcagcctgcctcgtgtcgtgggtcctcctgacngtcattaccatctcctgcacgtggaaccagcctagtgacgttggactagttatgtactatcggtcctcctacggttaacccaactacgttaacccaggacctaaaaccgaccccccaaaactctaatttaagtttacgtagtatcgtccgtcttaacggtccgtccccgttacggtacggggttttcctaaccggtcctttccgtctcggtcctacctacgtctaggaccaacgacgtccctacctcgacctctctcgtggacctcgnggctggacggacggtaggcttagtatttacttgttgcgtacgtcgtacacgactaacccaactaacttaacctacttaccgttcgggtttaccggacgggttacggaccgttacgtacgggtcccgttaccgttaacggttaccgaccgaaccggtccgttacccgcccccggtacggtacccttcgtccgttaccccg

SEQ ID NO: 17020 - DNA, 745 bp, Homo sapiens
  misc_feature: GYAE6OF02JNSN6.34.36.D03.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagtacacgtgatcacgaccggtgctcgatttagctgcgtcacgatctctcgttgggggggggtctcaggaggcagcgctcgtcgggagtctccaccatggcctgggctctgctacttcctccaccctcctcactcgagggcacgtagggtccgtcggggacccaatcctcgccctgactcagcctgcctccgtgtctggtcctctggacngtcgattaccatctccngactactcggaaccgagcaggtcggtacgttcggtactagtttatcgattactggttccttcgtaccgtaaccaaccaacccgacccggacaaacgcctaccaactctagtagttactttaancgtaatacgttacgaactacgtcccggtaccttaggtacggtttgtttaccnctacgtttcgtacttctcgttaccgtcctactacgttcgtcgtacccggtactaaccgtccgtccctaccgtaccacgttaccgttacccgtggtaccgtactaccggtacggtacgtacgggtaaaccgggtacgggtaaggtttacggttaaactttcgttaacccgtttcggactttaacccgtataacggttaacttacttaaccgttaccgtacttacccgtaccgtaccgttacacgtttacgtgtttaacggtcccggttaacggggtaccggtaaaccggtaccgtacccgtacccggttacccgtttacccggttacgtaccctaacccggg

SEQ ID NO: 17021 - DNA, 892 bp, Homo sapiens
  misc_feature: GYAE6OF02FZ9ER.34.36.D03.1.454.CMB.1.raw
tcagtacacgtgatcacgaccggtgctcgatttagctgcgtcacgatctctcgttggggggggtctcaggaggcagcgctctcgggacgtctccaccatggcctgggctctgcttattccgtccaccctcctcactcgagggcacgtacgggtcctgggacccaatctgccctgactcacgcctcgcctccgtcgtcgtggtcctccgtggactagtacgtacttaccattcctcgtgcctacgtacggaaccagtactaggtcggtaccggtttcggactactttagcgttaactacgtccgttccgttaccggtaacgtaacctaaaccgtccgttaacccgaacgggtaacctaaacccgtaaccccctaacgttactttaactttaaacgttcgtaacgtacgttcggttacccggacggttttacccgggtaccccgggttacctttacgggggtttaaccggggtttaccttaacgttcccggttactttccggtaccggttccgggttaaccccgtttacgtaaaccgggtttcgtaaaccgggtaacccgtaaacccggttacccggttaccccggttaccgtactaaacccgtcctttacgggtacccgggttacgggtccccgttcgggaccggtaccggttacggaaccggggtgtaaccggttcggttaaacgttgtttttaacgccgttacgggacctttccgaccttaaccggtaactaccgttaaacctaacctttacttaacgttaccgtttccgggtttgggtaacccgggtacgtacggggttaaccttacgttacccggtaccgttacggtacccggacgttcccggaacgttcccggaccgttaccccggttccggtacgttccctaccggg

SEQ ID NO: 17022 - DNA, 732 bp, Homo sapiens
  misc_feature: GYAE6OF02GMO6M.34.36.D03.1.454.CMB.1.raw
  modified_base (726)..(726): a, c, t, g, unknown or other
  misc_feature (726)..(726): n is a, c, g, or t
tcagtacacgtgatcacgaccggtgctcgatttagctgcgtcacgatctctcgttgggggggggtctcaggaggcagcgctctcgggacgtctccaccatggcctgggctctgctattcctcaccctcctcactcgagggcacgagggtcctgggccccaagtctcgccctgactcacgcctgccctccgtgtcgtgggtcctccgtggacagtcgattaccattcctcctgccacgtacggaaaccaggactaaggttggtacggtttggtacctaatttaatcgtacttagttcgttaccttccgtacggtaaccaactaccgttaaccgaggaacctaaaccggaccccctaaacgttctaatttaactttagtagtacgttcgtacggtacgtacggtccgtccgttacggttagggtttactaacgtcgtcttcgtcgttacggcctacgtacgtccgtacggacctaaccggtcccgtaccgttaccctacgacctacgtccggtcgtcggtccgtacgaccggtcgtaacgggacgtacggtacggtagttacgtatttaataacgttcgacgtcgtactaacgtaacctaacgtaacctaaacctaacgttaccgtaacgtttccggttaggttaccgggacggttacggtacgtaacgggtccgtaaccggttcctacgtaccgacgtacgtacggtccttacccggccgttacgtntacccg

SEQ ID NO: 17023 - DNA, 727 bp, Homo sapiens
  misc_feature: GYAE6OF02FJ00N.34.36.D03.1.454.CMB.1.raw
tcagtacacgtgatcacgaccggtgctcgatttagctgcgtcacgatctctcttgggggggggtctcaggaggcagcgctctcgggacgtctccaccatggcctgggctctgctattcctcaccctcctcactcagggcacgagggtcctgggcccaatctcgccctgactcagcctgcctcgtcgtcgtgggtcctccgtaggactacggtcgtattaccatcctcgtcgctacgtacggaaccagtcagtgtacggttgtactattagtgtacgtatcgtctccgtacggtaaccaactactaccgaggacctaaccgaccctaactctagttatttagtgacgtcgtcgtactacggtccgtccgttacggtacgggtttctaactcgtccttactcgtcgtcgtaccaacggttctacggaaccgtacgtaccgtcccgtccctacggtacctacgtccgtacggtcgggtccctacggtccggtagtacggacgggacggtacgtgttacgttagttaacgttcgtacgtacgtaccggtactacgtaacgtactaaacctaaccgttaaacttaacccgtaacgtttccggtttacgggttaccgggttacgggacggtaacggtacggttaaccggtacccggttaccgttaccgtaacggacccggtaaccgtacccgggtaccgtacccggttaccccgtcggttacccttacccggg

SEQ ID NO: 17024 - DNA, 851 bp, Homo sapiens
  misc_feature: GYAE6OF01BKE4M.39.12.B01.1.454.CMB.1.raw
tcagtcgcactagtcacgaccggtgctcgatttagtagtgtagattcgacgggacccaaaaccaacggacccctccgttgggagaatccccctaacgagtcacagctcctcgaccatggacgtcggacctggagcattcccttttcggttggtcggcagcaactaacagggtcgcccactcccgaggttccagctggtacagtctcggagctgacgatcgacgaagccctcggggcctcagtgaaggtctcctggcaaggcttactcggttaccacctttaccaacttagtcgggtatcgtaggttgggtagacgtacgacggccctggactaagggtcgttaggtaggttggagtaggggaacttaacgggacgtacgaacggtacccgtaacctttaaccgaagttacgggttaccaaccgtaactaaaacgttactaccgtaccgtaaaccgtaaacggaaaccccggttccggaacgggtacctaaacggtaacggttacccgaaaccgtaaggttacggaacccgtaacgaacggtaaccgaaccgtaacgttacccgttaaccggtaccgaacccgtaaaccgggtaccctaacggaacgtacgggaacccgttaggaccgggacgtcccgttaggaacgtactacgtacgaaccgtaacgaaccgggtaccgttaggttactttaccgtagtacggtacgaaggtaacggtacggttaaccggggttaaatttaccggttttacggtaacccggtttaccggggttacccggttaaccggtttacgggtaaccggttaccgggttacgggggaccctaaacggggggttaaccccttacggggg

SEQ ID NO: 17025 - DNA, 689 bp, Homo sapiens
  misc_feature: GYAE6OF01AZAFE.39.12.B01.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagatttcggcgggggacccaaaaaaccgacacccctccttgggagaatcccctagatcacagctcctcaccatggactggacctggagcatccttttcttggtggcagcaacaacaggtgcccacttcccaggttcagctggtacagtctggagctgagatgacgagccgtgggcctgagtgaggtctctgcaggtcttcgtgttacctacctttacaactatggtactcgtaggttgggtcgcgacgtacggtcccctaggaccgaagggtctttggacgtgggacgtggggatcgggatcgaggcgtacttacgagtggtacacgaactaaacgtatcgacacgaacgaacctccgagggacaggtagtaccactagtacgaacccanacgaccacgacgtaccgaccggacgtcccgaacccgtacctaacgacgtaccggaaccgtacggaaggaaccgaccgtaggaacgtacgttccgagggaacctaaccggaccgggtaccgttagtaaccgtttacgaggtacgacggtaaggacgtaacggtaacggggttaaatttcgtttaaggccgtttacgggttacccttgttaacgtaccggttaccggaggggtaacccgtaccgggttaacccgtccggg

SEQ ID NO: 17026 - DNA, 732 bp, Homo sapiens
  misc_feature: GYAE6OF01D8HWB.39.12.B01.1.454.CMB.1.raw
  modified_base (286)..(286): a, c, t, g, unknown or other
  misc_feature (286)..(286): n is a, c, g, or t
  modified_base (375)..(375): a, c, t, g, unknown or other
  misc_feature (375)..(375): n is a, c, g, or t
tcagtcgcactagtcacgaccggtgctcgattttagtagtgtagattcggcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctcgagtgaagtcctccgtgacaaggtcttctaggttaccacctttaacaacttagtgtatcgaggtttggncgacacggccctggaacaagggtcttagagtggagtgggagtagggatcgaaggccgtacttaacgaagttcggacaacaactaactanacggacaaccgaacgtaaaccctccggaggacaaggactacaccgagtacaacgtacaagaccacaacgtcccaagacgacgacggacctaacgtagaccggtacgacggtacggaacgtcgtacggaagtaccgtaccgtaggaaacccgtaccggaaccgggttaccgttaaggttaaccgtttcgtacgggttacggacgggtaacggtaaacgggtaacggttaaccgggggttaaattttaaccggttttaggttaaccggtttcccggggtttaaccctttacggttaaccgtttacccggttaacggtacccggggtaacccggtaacccggggttcccgttaacccggg

SEQ ID NO: 17027 - DNA, 779 bp, Homo sapiens
  misc_feature: GYAE6OF01C5OSR.39.12.B01.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagtcgcactagtcacgaccggtgctcgatttagtagtgtagattcgtcgggggtacccaaaaaccacacccctccttggggaggaatcccctagactcacaggctcctccaccgatggactggacctgggagcgactcctttcttgggtggcagtcgaacaaccaggtcgcccactcccgaggttcagctggtacngtcctgganctgagtattgacgaggccgtggggcctnaggtgaacggtcgtaccgtgacgaaggtcttagtagggttaactacccttttaccaacttagtagggttaagttcggtagggtttcgggttacgacggaccgtaccgggtcccccttagggaaccgtaaggggtctttacgggaggttacggaaggtaggggtatcgggtatcgaacggtccgtacttaacgaacgttacgggtaccaaccgtaaacctaaaagtagtacggtaccgaacgtaacggtaaccccgtccggaacggggtacaacgggacgttacccgacggtacttacgtaacccgagaacggacaacgtactaccggaacgtagacctacggtactacgtaagttccggtactaggacggtacgtcgtaggacgcgtccgtcgaaccgtacggtacggtcgttagtacttacggtcgtcgacgtaggtacgtacggtacggtaacgttcgtttacggaccgtttccgggttacccctttacgtacggtaccgttacccgggcggggtaaccctccggggtaacccgttcccggg

SEQ ID NO: 17028 - DNA, 733 bp, Homo sapiens
  misc_feature: GYAE6OF01AUIGM.39.12.B01.1.454.CMB.1.raw
  modified_base (639)..(639): a, c, t, g, unknown or other
  misc_feature (639)..(639): n is a, c, g, or t
tcagtcgcactagtcacgaccggtgctcgattttagtagtgtagattcgcagggacccaaaaaccacaccccctccttgggagaatcccctagatcacagctcctcaccatggactggacctggagctatccttttcttggtggacctagccaaacaacgaggtcgccccactcccgaggttccagctggtacagtcgtggagcgtgagtagtagaaccgaagccggtgggccctacgaggtgaagtcctccgtgacgaaggtcttcgttacggttaaccctaccctttaaccaacgttagtacggttatacggtaggttggtacgacgaccgtaccggcccgtaggaacgtacggtcgttaggaggtgggtacggtaggggtatacgggtacgtaccgaggtacccgttagttaacgagttaccggacaaaacctaaccgtaacttacgtacgaaccgtaacgtaaacccgacccgtaaccggacgggacaacggtacgtaacccgacgtaactacgaaccgtaccgagtaaccacgtacctaccgaccgtcaccccgagtacccagaccgtacgtacgtaggacgacgacgagacgtatccgaggaccgtacggacgttaccgtatccgttacgagngtaacggagtacggtaaggttaggtatttacggtagtcccgttaacggttccttacgttcgaccgttaggaaccccgggcgtaaccggttaccg

SEQ ID NO: 17029 - DNA, 1034 bp, Homo sapiens
  misc_feature: GYAE6OF01BGA0S.39.12.B01.1.454.CMB.1.raw
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
tcagtcgcactagtcacgaccggtgctcgattttagtagtgtagatttcgcggggacccaaaaaccacacccctccttgggagaatccccgtagatcacagctcctcaccatggactggacctggagcattccttttcttggtggcagcaacaacaggtcgcccactcccaggttcagctggtacagtctggancgtgagntgacgagccgtgggcctcagtgaacggtctccgtgacgaacggtccttcgttaggttaaccttaccctttttaaccaaccttagtacggttaacttaccgtaaggtttcggggttacgccgtaaccgacccgggtacccccgtagggaaccgtaaacggggtccgtttagggaacggttaccggaaggttacggggtacttaggggtaacttaccggaacggtcccgtttaccgttaaacgtaacggtttccgggttaaccctaaacccgtaaaccgttaaaaaccgttacggttaccggaacccgtaaaccccgtaaaccgggtaaaaccccccggttacccgggtaaacgggggtacccgttaaaaccgggtaaccggtttaccccgaaaccccgtaaaccggttaaaccggaaaccccccgtaaaccgaaccggtaaacccaccggtaacccgtaccccggaaacggggaacccggtaaccccgtaaaccccggggtaaccccgttaaacggtaacgggttaaccgggttaaccccgttacggggtaaaccgggtaacccgtacccggttaacgggtaacgttaaccgttaccggtaaccggttaaccccggtaaccggttaccccgggttacccgtttaacggttaaccgtttaccggttaggtacccggaacggtaacgggtaaggtaacgggtttaaaccggggttaaattttacggttttaaccgaccgggttttacccgttaaccccgtttacgttttaacccggtaacccgtttaccggggttaccggggaacccctttacccggggtaacccgtttccccggg

SEQ ID NO: 17030 - DNA, 876 bp, Homo sapiens
  misc_feature: GYAE6OF01ELB3C.39.12.B01.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (736)..(736): a, c, t, g, unknown or other
  misc_feature (736)..(736): n is a, c, g, or t
  modified_base (779)..(779): a, c, t, g, unknown or other
  misc_feature (779)..(779): n is a, c, g, or t
tcagtcgcactagtcacgaccggtgctcgatttagtagtgtagattcggcggggacccaaaaaccacacccctccttgggagaatcccctagatcacagctcctcaccagtggactggacctggacgctacttcctttttcgtgggtacggcagacaaacaacgaggtcnccctactcccgaggttcagtcgtaggtacngttcgtggagctaggagngtacgacgacgtccggtcgggcctaggcggtagtacggtccttcggngaacgtacggttaccttacgttacgttaccgttaaccttaccgtaagttagttcggttaacgttcggtagggtttcgggacgtaccggtaccggtacccggtacccggtaaggtaaccggtaaggggtttccggtagggttaagggtcggggtaacggtttaagggggtacgtttaagggaaccctacgggttaccgggtaaacctttaacgggtttaaccgtaacggttttaccgggaaacccctaaaaggtaaacccgttaaaccgttaccggtaacgaacccggaaccggtaaaccgtacccgggttaacccgggacgtaaacggaacgtaccggtacccaccggtaactaaccgaaaacgccgtaaaccgcccgtaactaccgaacccggactaaccgggaccctaacgggtaaccttaacgggacgtaccgggagtacgggtacggaccttcgggaagtaaccgtntacccgtgggaaccctcgggttaccgtacgttaggtttaaccngggacgacggtgaacggttaggtacggtaagttactttgtacggttctacgttccttagtacggacgttacgggccggtaaggtcctcgtacccggg

SEQ ID NO: 17031 - DNA, 724 bp, Homo sapiens
  misc_feature: GYAE6OF01DNHA5.39.12.B01.1.454.CMB.1.raw
tcagtcgcactagtcacgaccggtgctcgatttagtagtgtagatttcgcgggggacccaaaaaccacacccctccttgggagaatcccctagatcacagcctcctcaccatggactggacctggagcatccttttcttggtggcagcaacacaggtgcccactcccaggttcagctggtacagtctggagctgagatgacgaagcctggggcctcgacgttgaagtctcctgcaaggcttctggttacacctttacaactatcggtatcgtagttggtgcgacgaggcccgtaggacgaggtcttgaggtggcgtgggatcggatcgagtcgactttaacgaagtcggtcaaccaacgaaactagtcgacacgtaacgtaaccctaccgagggactacggacggtccaaccatacggacctaacgtacgaacactacctaccgacggaacgtcaaccggtacctaacgtacgtacggaaccgttcgggacggaagtaccccggtagaacgacgttacgttacggaccgaaccgtaccgggtcccgttaggtttaacgttacgttagttacggccggtaaaggtagggttaacgttaccgggggtaaaattttaccggttttaaccggaacggttttccggttaacccctttacggttttaacccgtaccgttaacccgggttcggggtaaccccggttaaccgggtaccccgttttacccggg

SEQ ID NO: 17032 - DNA, 759 bp, Homo sapiens
  misc_feature: GYAE6OF01CRRGO.39.12.B01.1.454.CMB.1.raw
tcagtcgcactagtcacgaccggtgctcgatttagtagtgtagattcggcggggacccaaaaaccacacccctccttgggagaactcccctagatcacagctcctcaccatggactggacctggagcattcctttcttgggtggcagacaacaacaggtcgcccacctcccgacggtttcacgcgtagggtacaggtccgtagggagcgtaggagagtaggaaccggaacgcccgggtggggccctaggaggtaggtaacggtcctccgtgacgtaagtcttcgtcggttacctaccttaccatagtggtatcgtaggttggtcgacgacgccggacccgtagggaccgaagggtcgtgggacggtagggtagggtagggtagtcggacgttacgacggtaccgtaacgtttaacagggtttacggaccaaccgtaactaaacgtcgtacgaaccgtaaccgaacccgtaaccggtaccggaacgggaacacggtaaccgacctaaccgacggtaacccaacaccgtacgaccgaatacccacggagaccgacgtacccggtacctagaccgcgacgtggaacgtcgagtacggactcgacgtaccgggaactaccgggacgttcgtacgttaccgtagggtcgacgggtaagacggaaggtacccgggttaaggtttacgttacggttaccgtacggttaccgttaccgttacgttacgaccgggacggtacgggaacctcggggtaaccgttacccg

SEQ ID NO: 17033 - DNA, 687 bp, Homo sapiens
  misc_feature: GYAE6OF01AJ64K.39.12.B01.1.454.CMB.1.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (470)..(470): a, c, t, g, unknown or other
  misc_feature (470)..(470): n is a, c, g, or t
tcagtcgcactagtcacgaccggtgctcgatttagtagtgtagattcggcgggggacccgaaaaaccacacccctccttgggagaatcccctagatcacagctcctcaccatggactggacctggacgcattccttttcttggtggcagcaacaacaggtgcccactccccaggttcagctggtacagtctggagctgagatgacgaagccgtggggcctnagtgaagtctctgcaaggcttctggttactaccttaccactatggtatcgtagttggtgcgacncggccctggacaagggtcctggagtgggatgggtatggatcgacggcgtacttaacgaagttcggtacctaacgtaactaaacttagttcgactaaccgaccgtaaccctccggaaggctaacggagtaccaccgtataccgaaccacgacgtacaactactaccgaagggacgccgtaccgganaacgttaaccgtagtaccggtaccgttaggaaccgggtacgacctagggtacgattacgaccggaccgtaacggacccggtcggttaattaccgtacggtgtacggacgaggtaggtaacggtagggttaacttaggttaactccggtttacccggtaacctttcgggttacaacccggtttaacggccggggtaaccccgtaccgggttaccccgg

SEQ ID NO: 17034 - DNA, 942 bp, Homo sapiens
  misc_feature: GYAE6OF01B0YZF.39.12.B01.1.454.CMB.1.raw
  modified_base (83)..(83): a, c, t, g, unknown or other
  misc_feature (83)..(83): n is a, c, g, or t
  modified_base (131)..(131): a, c, t, g, unknown or other
  misc_feature (131)..(131): n is a, c, g, or t
tcagtcgcactagtcacgaccggtgctcgatttagtagtgtagattcggcgggaacccaaaaaccaccacccctccttggganaactcccctagatcacagcctcctcaccatcggactgggaccgtgganctactttcctttttcgttggggtggaccaagccaaaaccaacgtacgggtccgaccccctacccgttacccgtacgggtttaccacggtccgttagggtaaccttacgtttcggtaggggacgtcggtaaggaggtagtacgggaaccggaaccggtccccggggtacggggtccctaggtacgggttaagggtaccggtttcctccggtacggacgtaacgggtttcctttaccgttaccgggtttaacccttaacccttttaccgaaactttggtacggttagttacggtagggggtttcggggacgtaccggacggtacccggtcccgggtaagggaacggtacgggtcgttgggacgggtggtagggtcggggtaagtggtctacgcggtaaccgttacgtaacgtaagttccggaaccaaacctaacgtaaacgtcgtacgaaacccgtacggtaaacccgtacccgggaagtacgggacgaacggttaaccaacccgtaaccgagtaccccgaaacctacgaacacccgtaccaaccgtaccggacaccgggaaccgtacccgtaaccgccgtaacgggtacggaccggtacgggacggacgtaccggtacggtacgtacgtaccgggacgtaccggtaaccggtcggttaccgttaggtacgttacggtaggtacggacggtagggtacgggttaaggttaaggttaaccgttggttaaccctacggttaccgtttaccggttagtttaacccgggtcgttaccggggtaacccggtacgggtacccggttaccggttacccgg

SEQ ID NO: 17035 - DNA, 755 bp, Homo sapiens
  misc_feature: GYAE6OF01B2LMC.39.12.B01.1.454.CMB.1.raw
  modified_base (405)..(405): a, c, t, g, unknown or other
  misc_feature (405)..(405): n is a, c, g, or t
  modified_base (564)..(564): a, c, t, g, unknown or other
  misc_feature (564)..(564): n is a, c, g, or t
  modified_base (624)..(624): a, c, t, g, unknown or other
  misc_feature (624)..(624): n is a, c, g, or t
tcagtcgcactagtcacgaccggtgctcgatttagtagtgtagatttcgcgggggacccaaaaaccacacccctccttgggagaatcccctagatcacagctcctcaccatggactggacctggagcatccttttcttggtggcagcaacacaggtgcccactcccaggttcacgctgggtacacgtcttggagctgagatgacgacgaccgtcgggcctcgagttgaaggttcctccgtgactaaggtccttcgttacggttaacctaccctttttaccaaacttattcgggttactccgtaagggttcgggttcgaccggtaccgacgggcccccttaggggaacgaacggggtcttggtaaggtggacggtgggacgtggacttcgacggcgtaccgttaanacgtcggtacaacgaactaaacgtataccggacaacgaacggtaccctaccgagggtccaaggtacgacccacgacgtacgaaccacagaaccacgacctaccacgtacgactaccggacctaagaacgtcggaacctagggacggtacctcgggtaancggtaacgtcctaacggacccggtaggacccgtaccgggttacgttctttacggtacggnacgggtaacgaggttaacggtaggggttaaactttggttaccgggttacgttaaccggtttcccgttaccgtttacggtaccgtttacgggaccgggggttccccggtaaagggtccccggttaacccggg

SEQ ID NO: 17036 - DNA, 801 bp, Homo sapiens
  misc_feature: GYAE6OF01EOX4R.39.12.B01.1.454.CMB.1.raw
  modified_base (195)..(195): a, c, t, g, unknown or other
  misc_feature (195)..(195): n is a, c, g, or t
  modified_base (633)..(633): a, c, t, g, unknown or other
  misc_feature (633)..(633): n is a, c, g, or t
tcagtcgcactagtcacgaccggtgctcgatttagtagtgtagatttcgcggggacccaaaaaaccacacccctccttgggagaatcccctagatcacagctcctcaccatggactggacctggagcattccttttcttggtggcagcaaacaacaggtgcccactcccgaggttcagctggtacagtcgtgganctagagatagacgaagccgtggggcctacgagtaggaacggttctcctgacgtaacggtcttcgtacggttaacctaccctttaacaacgttagtacggttattaccgtaggtttcgggacgaccggtaccgaccgggtccccgtaggtaacggaacggttcgttaggtaaggtagggacggtagggtacggttaaggtctacggtacggcgttaccttaagaagttcggaacctaactaaaacgtaaactcgtacgacctaacgaaaccgtaccgtaccggaagggtactaaacgggtccaacctaccgacgttaaccgaaacccgaaactaaggaaaccctaccggttaacccacccggtaacggtaacgaacccggtacccgttaacctaacgtaacccggtaaccggtaccgacgggtaaacgtccgtaaccgnggtaacgtccgtacggtcgaaacccgaccgggtacccggttagttaccgttaacgttaggtcgtaggacggtaagacggttaaacggtacggttaaatttacggtcgtacgtttcgttacctttcgttaggaccgttacggtacggtaccggtaccgcggttaacccg

SEQ ID NO: 17037 - DNA, 819 bp, Homo sapiens
  misc_feature: GYAE6OF01DYMRD.39.12.B01.1.454.CMB.1.raw
  modified_base (164)..(164): a, c, t, g, unknown or other
  misc_feature (164)..(164): n is a, c, g, or t
tcagtcgcactagtcacgaccggtgctcgatttagtagtgtagattagcgggtcccctagatcacagctcctccaccatggactggaccgtggagcattccttttcttggtggcagcaacaacaggtgcccactcccaggttcagctaggtacagtctggacgntgagatgagaacgtccgtgggcctgagtgaacggtctccgtgacgaacggctttacgttcggttaacctacccttttaaaccaaccgttagttcgggttaacttcgttaacgggtttgggttacggaccggtacccaaccgggcccccgttaggggaaccgtaaacggggtccgtttaggacggttagggaggttagggtaagttaggacgttaccgaagggtccgtaaccgtttaaaccgaacgttagggtaaccctaaacgaacccgtaaaactttacggacgacgtaaacccgaaccggtaacccgtacccggacggacgaagtacgaccaaaccgttaagaccggaaaccaacggtaacgaacccgaactaccgaacccgacggaaccgtaccgaacccggtaccgtaactacggttaccggaaccgtacgggtacgtacgaccgtaggtaacgagttaccacgggtaacccacggtacccgtacggttagtttacgttaccgagtacggtacggtaagtaacccgtgggttaaacggttaatttcggtttagacggttcctcgttaacgttcgaaacggttcggacgggaaccgtcggtaaccccgttcaccgttaccccgcttaccgtacgaccccgtcccgtaacccg

SEQ ID NO: 17038 - DNA, 816 bp, Homo sapiens
  misc_feature: GYAE6OF01DGZYD.39.12.B01.1.454.CMB.1.raw
  modified_base (788)..(788): a, c, t, g, unknown or other
  misc_feature (788)..(788): n is a, c, g, or t
tcagtcgcactagtcacgaccggtgctcgatttagtagtgtagattcggcggggacccgaaaaaccacaccctccttgggagaatcccctagatcacagctcctcaccatggactggacctggacgcacttccttttcttggtcggcagcaaacaacaggtcgccctacgtcccaggttcaagcgtggtacagtctggagctgagagtaggaacgaacggtccgtcggggcctacgtaggtacgtaacggtcctaccgtaggacgaacggttcctttaccgtcggtttaacctaacccgttttaacctaaacgttagttaggtaaccttacggttaggtttcggggtcgaccgtaccgaccgggtacccgtaggtaaccgtaagggtcctttaggaggttcgggtaaggttcgggaagtgggtaacgtacggacggtccgttaacgttaacgaaggtttacgggacctaaaccgtaaacgtaaacgtacgttaccggactaaaccggtaaaccgttaaacccggaccggaacgggtacgaaaccggtaccgtacccgtaacgaacgttacccggaaaacctacggaacctacccggaaacgtaccgtacccggtaaggaccgtacccggtaacccggtacttaaacggacgtaccggtaaccgtaggaccggtaaccgtagtacggagttaccctcgggacaaccggtacggaccgttgttactacgttcgtcgggacgacgaaggtagtacgggtagtaactttcggtgtaacggtcttacgtttanagtccgtaaggccggtacgcggtctacg

SEQ ID NO: 17039 - DNA, 583 bp, Homo sapiens
  misc_feature: GYAE6OF02JD77P.39.12.B01.1.454.CMB.1.raw
  modified_base (376)..(376): a, c, t, g, unknown or other
  misc_feature (376)..(376): n is a, c, g, or t
tcagtcgcactagtcacgaccggtgctcgatttagtagtgtagattacggacgggggacccaaaaaccgacaccccgtccgttcgggaagaatacccctaagatcgaacagctcctcaccatggactggactggagcatcctttctgtgcagcaacaacacggtgacccactcccaggttcagctggtaccacgtctgggacgctggagtacctggacgaacgcctggggcctcgagtcgaacggttcgtcctgcaaaggccttcgtcggttacgacctttaccaactatcggtaatcagttggtgcgacaggccctggacaagggcttggagtggatgggatggatcgagcgcttacaatggtcacaacaaactntgcacagaaccctcgagggcagagtcaaccatcgaaccacagacacatccaagagcacggcctacatggacctggaacggagcctagacgatctgacgaccgacggtcccgtgtaacgttactgtcgacgagagagtacggggaattagtttgaacgttcggtacccttgttacgacttaccgaggggccgtaacgggacccttcgg

SEQ ID NO: 17040 - DNA, 651 bp, Homo sapiens
  misc_feature: GYAE6OF02FMCSA.39.12.B01.1.454.CMB.1.raw
  modified_base (262)..(262): a, c, t, g, unknown or other
  misc_feature (262)..(262): n is a, c, g, or t
  modified_base (372)..(372): a, c, t, g, unknown or other
  misc_feature (372)..(372): n is a, c, g, or t
tcagtcgcactagtcacgaccggtgctcgatttagtagtgtagattacgcggggacccaaaaaccgggacacccctaccttgggagaatccccctagatccgacagcctccctcaccgactgggacctggacctggagcactccttttcttggtggcagcaacgaacaggtgccccacgtccccaggttcagcctggtacagtctggagcctgagatggacgagcctggggcctcagtgaaggtctcctgcaaggcttaccnggttacaccttacaacttagtggttatcaggttggtgcgacaggccccctggacgaagggctcgagtggatgggtatggatcagcgcgtacaagtgggtcacgacaactngcacacgaacctccgagggcaagacgtccacccataccgacctacagaccactactcccgacgacgaccgaaccggcctaacgacgtcggtaacccttaggacgggacgtccctaggaacgtactacgtacgaaccggaaccaacgggtacccgttagttaacgtttacgtgggttcgggacggtaacgaggtacggtaccggggtaatttcggtttacgaccgtacgggtacccttgtttcgacccgttggtccgggaccgtacgggtaaccctccgg

SEQ ID NO: 17041 - DNA, 746 bp, Homo sapiens
  misc_feature: GYAE6OF02GK5M4.39.12.B01.1.454.CMB.1.raw
  modified_base (255)..(255): a, c, t, g, unknown or other
  misc_feature (255)..(255): n is a, c, g, or t
tcagtcgcactagtcacgaccggtgctcgatttagtagtgtagattcggcggggacccaaaaaaccacaccccctccttgggagaattcccctagattcacagctcctcaccatggactggacctggagcatccttttcgttggtggcagcaacaactaggttgcccactccctaggttcagctggtacagtctggagctgagatggacgaagccgtggggcctcgagtggaacggtcctcctgcaaggtcttcnggttaccacctttaccaactatcggtatcgtaggttggtgccgacacggtccccctaggaccgtaacgggcttggaggtcggagtggggagtgggagttcgaggtccgtacttacgaaggttcggtacaacgtaacgtaaaactagtacgaaccaacgtaaccgtaaccctaccggaacgggacaacggtacgtacccgaaccgtactaccgaaccctacgtaaccgacaaccgaaccttacccgaacggaaccgacccgaaaccggtaccctaaacgtaccgttacgggaacccttagggaaacggtaccgtacccgtacggaacgtacttccggaacgaacccggaaccgtaccgggtaccgttagttaaccgtttacgtcgtacggaacgaaggtacggtaggtaacgggtaaatttcgtttaggaccgttacggttaccgttcgttacgccgttacggtcgggacccgtaccggtacccgttaccgg

SEQ ID NO: 17042 - DNA, 600 bp, Homo sapiens
  misc_feature: GYAE6OF02H6VY4.39.12.B01.1.454.CMB.1.raw
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
tcagtcgcactagtcacgaccggtgctcgatttagtagtgtagattcggcgggggacccaaaaaccacacccctccttgggagaatccctagatcacagctcctcaccatggactggacctggagcatccttttcttggtggcagcaacaacaggtgcccactcccaggttcagctggtacagtctcggagctgagatgacgaagcctggggcctcagtgaaggtctcctgcaggcttctggttacactttacaactatggtatcagttgggtncgacaggcccctggacaagggcttgacgtggatgggatggatcgagcgcttacaatgggtcacacaaaactntacggcaacagaacctccagggcaagcgtcacgatgaccanacgacacaactccaacgnacacggctacagtcggacctgaggagcctagagtactactcgacgaccgtacggaccgttagacgtttaacgtggtacgtcggaagaggtaacgtacgggggtaaaactttgttttacggaaccgttcggttaaccccgttcgttttaggaaccgtacgttacgggggccctaacgggggtacccttacccgggg

SEQ ID NO: 17043 - DNA, 857 bp, Homo sapiens
  misc_feature: GYAE6OF02JFZUS.39.12.B01.1.454.CMB.1.raw
  modified_base (124)..(124): a, c, t, g, unknown or other
  misc_feature (124)..(124): n is a, c, g, or t
tcagtcgcactagtcacgaccggtgctcgatttagtagtgtagatttcgcgggggacccaaaaaaccacacccctccttgggagaatcccctagatcacagctcccacactgacgtcgacgcgnggacactctttctttcgttggtcgacgcgacaaacaacggtggtccaccctaccctaccgttacggttacgacgtcggttacgtaacgtacgttcggtagggacgtcgtaggaagtagtacggaacgggaaccgtccggggtcgggtcctagtaggtaacgggtacgttcctcgtcgaacggtacgttcttacggttacgtacctttaacccttaacaacgttggtacgtactagttgggtttcggcgacgacggcccggtcgacggaaggtacggttcgtaggtacggtaggtagggtaggtacggtagtcgtacggacgtaccgttacttaacgtacggttcgaaccaacgtaaaacgtaacttcgaccgaacaacgtaaacccgtaccgtaccggggaacgtacgaagggttaccaaccgaacgttacggaaccccgaacaacggaaccaaaccgaccttaccgaaaccgacggaccgtaccgggtaaccctacgtaacgtaccgggaaccggtacgtaacggggacgtaccgtacggtaagacgttacgttcggaaccgaacggacccggtaccggttcgttaacgtttacgtacggtcggtcgaacggtaggtagtaccggggtaaaagtttcgttttcgggttaacctaccgggtttaccgttaccttttaaggtaccgttacgggttaccgggaccggtaaccgggtacccggttaccggtaccgg

SEQ ID NO: 17044 - DNA, 837 bp, Homo sapiens
  misc_feature: GYAE6OF02IKPJ2.39.12.B01.1.454.CMB.1.raw
  modified_base (714)..(714): a, c, t, g, unknown or other
  misc_feature (714)..(714): n is a, c, g, or t
tcagtcgcactagtcacgaccggtgctcgatttagtagtgtagattacggacggggacccaaaaaccacacccctccttgggagaagtcccctagaatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctaggttaaccttactacctagtagtacgtactacgtggttggcgacgtacggacccgccggtagacggacgttcgagtacggaggtaggagtaggtagtcgtacggacgtaccgttacgtaacgttcggtacgtaaccaacgtaaaacctaagtacgtacgaaccgtaaacgtaaccgtaacccgtacgggaccgtacggtaaccggtaacctaaccgtaaccgtacggtaaacccgtaacccgaacgggtaaaccaacccgtaaccgtaaccgtaaacccgggaaaccggaccgaaccccgggtaaccggttaaccctacgggttaaccgggtaacccgggttaagaaccggggtaaccgtacccgttaaccgggtaaagttacccgttaacggtacccgggtaaacggtaaccccggtaaaacggggtccccgggtttaactttaaacggttaaccgtttacccgggnggggttaacccgaagtaccggggttaaacgtacgggggttaaaactttggttacggttaaccgtccgggtttaacctcgtttacgacgtaccggtgggaccctaccgggaccgtagttacccg

SEQ ID NO: 17045 - DNA, 735 bp, Homo sapiens
  misc_feature: GYAE6OF02GL8JX.39.12.B01.1.454.CMB.1.raw
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
tcagtcgcactagtcacgaccggtgctcgatttagtagtgtagattcggcgggggacccaaaaaaccacacccctccttgggagaatcccctagatcacagctcctcacccatggactggacctggagcatccttttctggtggcagcaacgaacaggtgcccatcccaggttcagctggtacagtctgagctgagatgacgaagcctggggccgtcagtgaaggtctcctgcaaggcgttctggttactaccttaccaactagtggtatccaggttggtgtcgacacggtccccgtaggacgaagggcgttacggtaggtaggacgtgggtaanggtactcgagcggtcttaanaacgtggtcgaaccaacgtaaactagtcgcaacaacgaacctcccgagggtacgagagtacctaacgaacgttacggaccaaccgtaaggaaccaaccgtaacgtaccccgaaacggtaacgacccgtaaacccgggtacccttaaccaacgttaccggtacccgtagggtaacggacgtaccgttcgaacgaaccttacggttacgaacggaaccgtaccgggtccgttaacgttaatttaccgttggttacggaccggtaggaacggtacggtaacggggtaaatttaaggtttacggtaccggttaacggttaccctttaccgtttagtaaccggtttaccggtacggggtaccgtaacccgggtacccttaccggg

SEQ ID NO: 17046 - DNA, 729 bp, Homo sapiens
  misc_feature: GYAE6OF02JGOUS.39.12.B01.1.454.CMB.1.raw
  modified_base (615)..(615): a, c, t, g, unknown or other
  misc_feature (615)..(615): n is a, c, g, or t
tcagtcgcactagtcacgaccggtgctcgatttagtagtgtagattcgtggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgagtctactgcaagcttctggttacacctttaccaactatggtatctaggttgggtgcgacgacggcccctggacgagggcttggagtggagtggggatcgggatcgaggtccgtacttaacgaaagttcgggtacctaacgtaacgtaaaacttagtacgaccaaaccgtaaacggtaaaccccttacccggaaacgggggacctaaacgggaacgttaaccaaaccccgaagttaaccgaaccccgaaaccgaacggaaaccaacctaacctacccgaaacgaaccggaccgaacccgggtacccttaaacgtaacgtaccgggtaacccgtagggtaacgggaacctccgtacggaagtactcgtacgacgaccgaccggtcgtagtacgttacgnggtacgacggagtaacgaggttaacgggtaatttcgtttacggacgttaccggttacccttgtttaccggacgttaccggttacgggggaccctaacggggttaccctaccggg

SEQ ID NO: 17047 - DNA, 735 bp, Homo sapiens
  misc_feature: GYAE6OF02J28DI.39.12.B01.1.454.CMB.1.raw
  modified_base (163)..(163): a, c, t, g, unknown or other
  misc_feature (163)..(163): n is a, c, g, or t
  modified_base (675)..(675): a, c, t, g, unknown or other
  misc_feature (675)..(675): n is a, c, g, or t
tcagtcgcactagtcacgaccggtgctcgatttagtagtgtagattcgtcggggacccaaaaaccacgacccctcctttgggagtaatcccctagatcacgaggctcctcaccatggactggaccctggagcatccgtttacctggtggcagcacaacaggtncccatcccaggttcagctggtacagtctggagactgagatgacgaagccgtagggcctcaacgtgaacgttcctcgtcgacgaacggtcttactcggttacctacctttaccaacttcgtaggtactcgtaggttcggcgtcgaacgcggtcccctaggacgaacggttcttggagttaccgagttcggatcggtaacgtcgaggtccgtaaccggttacaacggtttcggtaccaaccggtaactaaacgttcgtaccggtacaccggaaaccgtacccgccggtaacgggctaacggtacccggttaccaaccggtagtcccggtaaccgaaccggttacgacctacgtacgtcccgtaccgggactaaaccggcccgtaacgttacgacggtaccgaccgttacggacgtacggtaccggtagtaaccgtaacggtcgtaaccggtaaccgtaaccggtccggttacccgtagttaacccttacggtcttcgggacgtacgtaacggtnacggtacttacgttcaggtacctcgtgttacgactacggttcgaccgtcggacgttacgg

SEQ ID NO: 17048 - DNA, 657 bp, Homo sapiens
  misc_feature: GYAE6OF02HF7XM.39.12.B01.1.454.CMB.1.raw
  modified_base (83)..(83): a, c, t, g, unknown or other
  misc_feature (83)..(83): n is a, c, g, or t
  modified_base (149)..(149): a, c, t, g, unknown or other
  misc_feature (149)..(149): n is a, c, g, or t
  modified_base (153)..(153): a, c, t, g, unknown or other
  misc_feature (153)..(153): n is a, c, g, or t
  modified_base (234)..(234): a, c, t, g, unknown or other
  misc_feature (234)..(234): n is a, c, g, or t
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
tcagtcgcactagtcacgaccggtgctcgatttagtagtgtagattcggcggggacccaaaaaccacacccctccttgggganaatcccctagatcacagctcctcaccatggactggacctggagcatccttttctggtggcagcaanaacnggtcgcccactccaggttccagtcgtcggactgtcgtgggacgtctgagatgacgaagccgtgggacctgagtgaacgtcnctgacagcttacgtgttacaacccttacaacgtacgtggtactacggagttcggacgcgaaccgacggtacccgtacggaaacgacggggtacttggaggtaaggtgtggagtaggatcgagcgtactaacgtagtccgtagaacaaccgttaanaccgtgacaacgacacgttacgaggactacgcgttacaaccgtancgaacccagtaanaccgtacgacctaccgaagtacgaccgtacggacactaccggacgtaccggcggtaaggacgaaccgtgtaacgtaccgtagttaccggaacggtaaccgaccggtcgtacgttacgtactcgtagaccgtagacggtacggaaggtactagttacgaggttccggtacctagtcggttacgtaccgtagggacgtaccggtaagtccgg

SEQ ID NO: 17049 - DNA, 666 bp, Homo sapiens
  misc_feature: GYAE6OF02ID5J0.39.12.B01.1.454.CMB.1.raw
  modified_base (199)..(199): a, c, t, g, unknown or other
  misc_feature (199)..(199): n is a, c, g, or t
tcagtcgcactagtcacgaccggtgctcgatttagtagtgtagatttcgcggggacccaaaaaaccacacccctccttgggagaatcccctagatcgacagctccctcaccatggactggacctggagcatcctttttcttggtggcagcaacaacaggtgcccatcccaggttcagctggtacagtctggagctgagntgacgagccgtggggcctcagtgaaggtctcctgactaggcttctaggttaccaccgttttaccaacttatggttatcgtagttcgggtgtcgacgacggtcccctggacgaagggcttggagtggacgtgggatcggtatcgagccgtcttacaattcggtacaacgacaaacctatagaccctacaacgtaaccctccgaacgggacaagtacgtacccgaaccatccgaaaccacacggaacaccaactacccgaacgacgacccgaacggcctacgtacgtacggacccgtagggaacggtacgccgtacggatactccgttagaaccgtaccgccgggtaccgtcgttaactacgttcgtaggccgtaaggactagggtacgggtaattacggtttacgtacgtccggtttaccttcggtttacgtacgttcggtaccgggcgtacccgggtaaccttccgg

SEQ ID NO: 17050 - DNA, 723 bp, Homo sapiens
  misc_feature: GYAE6OF02HR2WC.39.12.B01.1.454.CMB.1.raw
  modified_base (156)..(156): a, c, t, g, unknown or other
  misc_feature (156)..(156): n is a, c, g, or t
  modified_base (514)..(514): a, c, t, g, unknown or other
  misc_feature (514)..(514): n is a, c, g, or t
  modified_base (586)..(586): a, c, t, g, unknown or other
  misc_feature (586)..(586): n is a, c, g, or t
tcagtcgcactagtcacgaccggtgctcgatttagtagtgtagattcgcgtggacccaaaaaccacacccctccttgggagaatcccctagatcacagctcctcaccatggactggacctggagcatccttttcttggtggcagcaacaacaggtncccactcccaggttcagctggtacagtctggagctgagatgacgaagccgtgggcctcagtgaaggtctccgtagcgaagcttctggttacctaccctttaccaacttagtggtactccgtaggtttcggtgcgtacgaccggccccgttggaaccgagggtccttaggacggtgggtagtgggagtggactcgagcgtacgtagaagtcggtacactaacaacgttgacgtaaccgacgtaacgaccgttacgaacgggacgaagtacgtaccgaaccacgtcaaccgacgtaaaccacgtaccctaatacccgaacgacggccgtaaccgacgtaacctacggtacggtaaccggngggaacgggtaccgtccgttaagacgtacgtcgtaagaccggaccggtacggaccgtttcgtacgttaacgngggttaccgaggtaaggtacgggtacggtaaccgggtttaaatttcggtttacggtaacccgtttaccggttacccttttcggttaccggtaaccttccgggggttacggacccgggttaacccggttaaacccggg

SEQ ID NO: 17051 - DNA, 787 bp, Homo sapiens
  misc_feature: GYAE6OF02GLEXZ.39.12.B01.1.454.CMB.1.raw
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (360)..(360): a, c, t, g, unknown or other
  misc_feature (360)..(360): n is a, c, g, or t
tcagtcgcactagtcacgaccggtgctcgatttagtagtgtagattccgcggggacccaaaaacccacacccctccttgggagaatccccctagatccacgagcctcctcgaccgatggactggacctggagcatcctttctggtgcngacaacaanacggtgcccactcccgtaggttcacgtcgtggtactacgtcttcggacgtcgttagagtatcggaacgaacgtccggtacgggggccttacgacggtaggtaacggttcctcccgttgtaccgtaacggttccgttcggttacggttaacccttaccttttaacccgaattagggttacgtacgttaccgttagggttccggnggtaccacggtacgtacccccgttagggaaaccgtacggggtacttacggggtacgtcggtaggtaggggtacgtacggacggttaccgagtccggtacttaacgtagtaccgtacgtaccaacgtaatactcgactagaccggtacacgtagggctaaacgccgttaactagactacccgagacctaataaccgctaactaccgacaccgcgaaccgttaccaacgacgttaccggactacggtaaccgtgtaccgtagtaaccgttacgacttacgaacgggtaccctacgggtaccgttacgttaccgtacgttacgagttaccggagtacggttcgggaaccttaagtttacgtaccgttaacggttacgttacccgttgtacgtaccggttcgtaccgggtacccgtaccggtacgttaccg

SEQ ID NO: 17052 - DNA, 628 bp, Homo sapiens
  misc_feature: GYAE6OF02FLW1P.39.12.B01.1.454.CMB.1.raw
  modified_base (240)..(240): a, c, t, g, unknown or other
  misc_feature (240)..(240): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (380)..(380): a, c, t, g, unknown or other
  misc_feature (380)..(380): n is a, c, g, or t
tcagtcgcactagtcacgaccggtgctcgatttagtagtgtagatttcgcgggggacccaaaaaccacacccctccttgggagaatcccctagatcacagctcctcacccatggactggacctggagcatccttttcttggtggcagcaacaacaggtgcccactcccaggttcagctggtacagtctggagctgagatgacgagccgtggggcctcagtgaaggtctcctgcaagcttntggttaccaccttttaccaactagtggtatcaggttggncganacggccctggacagggtctggagtggagtgggatggactcaggtcgtacttaacgacttggaccaacaacgtaacttagacgccaacgacgtaaccnccggaaggcaggactccgaactagacgaccgtaacacgaacacgacgtacccagacgccaccggaccctagtactacgggacctgggtacggacgaccgtgaacggtactctaccggaccgtaaccggaccggtacgttagtaacgttcgcgtagacgaggtagacgtaacgggtaagtttgttacggaccgttgttacccttgttaccggtacttcggtaccgggaccgttaccgggaccgttacgg

SEQ ID NO: 17053 - DNA, 988 bp, Homo sapiens
  misc_feature: GYAE6OF02H52WI.39.12.B01.1.454.CMB.1.raw
  modified_base (147)..(147): a, c, t, g, unknown or other
  misc_feature (147)..(147): n is a, c, g, or t
  modified_base (862)..(862): a, c, t, g, unknown or other
  misc_feature (862)..(862): n is a, c, g, or t
tcagtcgcactagtcacgaccggtgctcgatttagtagtgtagattcgtggggacccaaaaaaccacaccccctccttgggagaatcccctagatcacagctcctcaccatggactggacctggagcattcctttttcttggtggcngacaacaacaggtgcccactcccaggttcagccgtggtacagttcgtggacgctgagatacggaacggaacgtccgtcgggggcctacgaggttacggaacggttccgttcccgtggaccgtaaggtccgttttaccggttaccggtttaacccttaacccttttaaaccgtaaacttaacgttagggttaaccttcgtaggggttttgggtaccggtaccgtacccccggaaccgggtcccccgtaagggtaacccggtaagggggttcccgttttaggggtaacggggtagggtaacgggtttggggggtaaaccggttttacggggtaaaccgttccggaaacgggttccccgttaaccggtttttaaacgtaaacgggtttaccgggtaaccgtaaacccgaaaacccgttaaaacgttacggtaccgaaccgaaaccgtaaaccggttaaaccccgtaacgggtacggggaaccgtaacgaaccgttacccaaaccgtaacggttaccgaaaccccaacggtaacccgaacctaaccgaaccgtaacccgaaccgggtaaccgacccggaacccggttccctaaaccgtacggtaccggtacggttaccgggaagggtaccgtacggtacgtaacgtacgtaccgtacggaacccggaccggtacccgggttacgttaccggttacgttacgttaggtacggtaaacggngtaacggtagggttacgggtttaaagtttcgttttaccgtaaccggttaccggttacccgtttacgttaccggttaccggtaccgggttaaccgggtaccgggtaccggtaacccgtttacccggg

SEQ ID NO: 17054 - DNA, 536 bp, Homo sapiens
  misc_feature: GYAE6OF01BGGLP.34.68.G02.1.454.CMB.1.raw
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgtttgttggtatcaacagaagccaggccagtcccctgtattggtcatctttgaaaataccaagcgggcctcgagggatcccgtagggcgatttccgtctggctccaactctgggaacacagccactctgaccatcagcgacgacccaaccatggatgaggctgactattactgtcgaggcgtgggacagcagtacgtcgcgggttttcggcgaagggaccagggtcgaccgtcgtaggtcgacgcccgaaggctcgccccgtcggtcacctctacgttcccgcccgtcctaccg

SEQ ID NO: 17055 - DNA, 521 bp, Homo sapiens
  misc_feature: GYAE6OF01BPPN0.34.68.G02.1.454.CMB.1.raw
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgtttgttggtatcaacagaagccaggccagtcccctgtattggtcatctttgaaaatccaagcgggcctcgagggatccctgggcgattctctggctccaactctgggaacacgagccactctgaccatcagcgaacgacccaacccatggatggagctgtactattactgtcaggcgtgggacagcagtactggtcggtttggcgaagggacaaggtcgaccgtccgtaggtcacggcccaggctcgccccctggtcactctccgtcccgcctccctc

SEQ ID NO: 17056 - DNA, 546 bp, Homo sapiens
  misc_feature: GYAE6OF01BGSJO.34.68.G02.1.454.CMB.1.raw
  modified_base (362)..(362): a, c, t, g, unknown or other
  misc_feature (362)..(362): n is a, c, g, or t
  modified_base (532)..(532): a, c, t, g, unknown or other
  misc_feature (532)..(532): n is a, c, g, or t
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgttgttggtatcaacagaagcaggccagtcccctgtattggtcatcttagaaataccaagcgggctcgaggactcccgtgggcgattctctggctccaactctaggaacacagccactcngaccatcagcgacgaccccaaccagtgatcgaggctagactattaccgtgtacgaggcgtggacagcaggtactggtcggttcggaggaacggacgagggtcgaccgtccgtaggtccacgcccgaaggcctaccggcccccgtggtacccacgttcctacggttccccncccgttcctacccg

SEQ ID NO: 17057 - DNA, 620 bp, Homo sapiens
  misc_feature: GYAE6OF01A25FQ.34.68.G02.1.454.CMB.1.raw
  modified_base (223)..(223): a, c, t, g, unknown or other
  misc_feature (223)..(223): n is a, c, g, or t
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctgganatcagttggggaataatattgtttgtggtatacaacagagccaggccacgtcccctgtattggtcatctttagaaaactaccgaagccgggtcctcgacgggactcccgtgggctacttctcgtggacctccaacgtcgtacggaacacgacgccactctcgaccatcacgcgaaccgaccccaaccagtacggagtcgaggctagtaactacttacgtgtcgaggtcggtacggactagcgtacgttacgtcggtaccgggtttacggacggtaaacgggaccgtaacgggtcgacccggttacgtacgggaccgtaacggcccgtaacggcccgtcccggcccccgtacggtaccctaccttcccgttacccgtccccctacccttccgtacccg

SEQ ID NO: 17058 - DNA, 876 bp, Homo sapiens
  misc_feature: GYAE6OF01CV9QS.34.68.G02.1.454.CMB.1.raw
tcagtacacgtgatcacgaccggtgctcgatttagtcgatagtgaagggaaaggggctgggcctcaggaagcagcatcggaggtgcctcagccagtggcatggactccctctccttccgtcggcgtccttgcttactgcacgaggactccgtggcctctatgagctcgacccaaccaccctcagtcgtccgtcgtccccgaggacagacacgccagccgtcacctgctcgtggataatcgtaggtaggggataaagtgttggtttgttgtaatactaacgagaacgccgacggacctaccgtccccgttagttacgttcggtactacgttacgtttaaacgaaaactaaccggaacggccgggtaccgtacggaaccgggtaccgttacccggtagggaccgttactttccggttcgttaccggtaccttaaccccgtaaacggtttccggtaaccggggtaaaaccacccgtaaccggtacccctaacccgttacccgtaccgtaaaccccgtacgtaacccggaacgggtaccccgaaaccccgtaaaccccgtaaaccccggtaagggtacgggtaacggttacggaaccggtaccgtttaaacggtaccttttaacgtttaccggtaccggttaccgggaacggggttccggttaacgggaagtaaccgggtacgttaacggttaccgggtttacgggtttaccggggtttacgggaacggtaaacgggtaccgtagggtacccgttacccggtaccggtacggaaccgaccggtacccggtaaccggttcccggtaccccggtcccccggttacgttacccgtcccggtttacccgaccccgtttccccccgtacccttcccgtaacccgg

SEQ ID NO: 17059 - DNA, 534 bp, Homo sapiens
  misc_feature: GYAE6OF02IZNGN.34.68.G02.1.454.CMB.1.raw
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattgggggataaatatgtttgctggtatcagcagaagccaggccagtcccctagtgacgtggtcaatctaatccaaagattataaagccggaccctcgtggggactccctggacgcgattcactggcttccatctctggaacacagccactctgaccatcaggccggaccaggctatagatgaggctagactatactgtcagacgtggacagacaccactgtacgctcgttcgggcggaacgggtaccaaggtcctacggtacccgtaccgtacggtaccgacggaccccgaagggtcctaccccgg

SEQ ID NO: 17060 - DNA, 497 bp, Homo sapiens
  misc_feature: GYAE6OF02GEMG7.34.68.G02.1.454.CMB.1.raw
  modified_base (388)..(388): a, c, t, g, unknown or other
  misc_feature (388)..(388): n is a, c, g, or t
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattgggggataaatatgtttgctggtatcagcagaagccaggccagtcccctgtgatggtcatctatcaagattataagcggccctctgggatccctgagcgattcactgctcatctctgggaacacagccactctgaccatcaggccggacccaggctanagagtgagctagactattactgtcagacgtggacagcaccacgtgtcgctcgttcggcggtaggaccaagcgtacgaccgtcgtacggtcacgcccgtaggctacccgg

SEQ ID NO: 17061 - DNA, 560 bp, Homo sapiens
  misc_feature: GYAE6OF02GCBCS.34.68.G02.1.454.CMB.1.raw
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgtttgttggtatcaacagaagccaggccagtcccctgtattggtcatctttgaaaatccaagcggcctcagggatccctgggcgattcnctggctccaactctggaacacagccactcngaccatcagcgacgacccaacccatggatgaggctgactattactgtcaggcgtgggacagcagtactggccggttttacgggcgtaacgggaccaagggtcgaccggtccgtacggtacacggacccaacgggcctcggccccccttcgggtccctaaccgttcccgtccggtttaccccctaccccttccctacccg

SEQ ID NO: 17062 - DNA, 700 bp, Homo sapiens
  misc_feature: GYAE6OF02F6NES.34.68.G02.1.454.CMB.1.raw
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgttgttgtatacaacagagcaggccagtccctgtattgtcatctttagaaaatacaagcggctgagggactcccgtggctattctcgtggctacctaactcgtaggaacacgacgccactctacgaccatcgacgaccgaacgaacccctaaacccagtacggtaacgtaggaacggtccttaggtaaccttaacgttaccgttacggtaccgtaacggggtcgggtacgggggacctacgggaccgtaacggttaccggttacgggttccggggtttttaccgggaaccgggtaaacggggaaccggtaaacggggttcgtaacccggttaccgttacgggtaccgaaccgggtaacccgaacgggtacccgttacccggtccccccgtttaccgggtacccgttaacccgtttcccgttacccggtttacccccctaccccgtttcccctaacccg

SEQ ID NO: 17063 - DNA, 736 bp, Homo sapiens
  misc_feature: GYAE6OF02IQDMP.34.68.G02.1.454.CMB.1.raw
  modified_base (232)..(232): a, c, t, g, unknown or other
  misc_feature (232)..(232): n is a, c, g, or t
  modified_base (498)..(498): a, c, t, g, unknown or other
  misc_feature (498)..(498): n is a, c, g, or t
tcagtacacgtgatcacgaccggtgctcgatttagtcgatagtgaagggaaagggctgggcctcaggaagcagcatcggaggtgcctcagccatggcatggatccctctcttcctcggcgtccttgcttactgcacaggatccgtgcctcctatgagctcgacccaccaccctcgacgtcgtcctcgtaccccaggaccagactacgccacgcgtccacctgctcgtagganaactcgtaggttaggggaattaaatagttcgttgtttcggtactacaacgtaagaacgccgacggccctaccggttccccttgttacgttcggtactaccgttcgtttaagaaaccttaccgaaggtcccgggacctacggacggtaccttcccggtgggtacgttacttcgtcgtcgtaccttaccgtactcggtaccggaactacgactaccgtataccggcaacctgtacacggcctaacgaccccctaacagtaacgtacgngtacggactacgttactacgttactacggttaccgaggttaccgggacgtacaacgtcgtacgttcggttaacgttcgggtttaccggagggtaaccggtaaccgtaacggttacgggttaccgtccggttacgggacccgttaccgacccggtaccggtaacccgttcccggtaccccgttccgttaccgttaccgttccggttcccccgttacccggtaccccctttccgaacccg

SEQ ID NO: 17064 - DNA, 736 bp, Homo sapiens
  misc_feature: GYAE6OF02IQUDJ.34.68.G02.1.454.CMB.1.raw
  modified_base (280)..(280): a, c, t, g, unknown or other
  misc_feature (280)..(280): n is a, c, g, or t
  modified_base (389)..(389): a, c, t, g, unknown or other
  misc_feature (389)..(389): n is a, c, g, or t
tcagtacacgtgatcacgaccggtgctcgatttagtcgatagtgaagggaaaggggctgggcctcaggaagcagcatcggaggtgcctcagccatggcatggatccctctcttcctcggcgtccttgcttactgcacaggatccgtggcctcctatgagctcgacccaaccaccctcgacgtcgtccgtcgtaccccgaggaccagacagccgacgcgtcacctgctcgtaggaataatcgagttaggggaataaatgttgtttgttaggtatacgtaanagaacgccgaggcctaacgtcccctagtacttggactagttctttaacgaaaacgtaccgtaaggccggtccgtacgaagggtcctcccggtgggtacctaagtttccncggttacggcctaccgaacgttccggtaggaaacctacgtaccgaccttaacttaccgacggtaacctacgtaccgaacgtacccgaaccgaacccctaaaccgtagtacggacgtacggacgtacgtacgtaacttacttacggtacgtacccgtaggtaccggtacggactaacggtacgtacgtacggtcggttaccgggtttaacggacggttaacggaaccgtaggtaccggtaccgttacgtaccggtacgacccggtaacggtaccggtccgtaccccgtacccggtcgtaccgttacccggtcccgttaaccggtcccccgttccgtaccgttaacccg

SEQ ID NO: 17065 - DNA, 503 bp, Homo sapiens
  misc_feature: GYAE6OF01C65NP.53.54.E10.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (399)..(399): a, c, t, g, unknown or other
  misc_feature (399)..(399): n is a, c, g, or t
  modified_base (473)..(473): a, c, t, g, unknown or other
  misc_feature (473)..(473): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagngccaccctntcctgcagggccagtcagagtgtagcagcgacttagcctggtaccagcaaaaacctggccaggctcccaggctcctcatctatggcgcatccaccagggccactgatatcccagccaggttcagtggcaggtgggtctgggacaggaattcactctcaccatcagcagcctgcagtctgaagtnttttggagttttattattgtcagtctagtataataactggtcctcgtactacgtttggcctaggggaccaagtntaggagatacaaacgactgtgctgctaacc

SEQ ID NO: 17066 - DNA, 565 bp, Homo sapiens
  misc_feature: GYAE6OF01C3JBV.53.54.E10.1.454.CMB.1.raw
  modified_base (208)..(208): a, c, t, g, unknown or other
  misc_feature (208)..(208): n is a, c, g, or t
  modified_base (399)..(399): a, c, t, g, unknown or other
  misc_feature (399)..(399): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctccgaaggggaaancgcccaccctctcctgcgagggccagtcagagtgtagcagcgacttagcctggtaccagacaaaaaccgtggaccaggcctcccgacggcctccgtcatctagtcggcgcactcccacgacgggcctacgtgactactcccagtccgtaggttcaggtggcgtaggtcggtcgtggactagtactcactcncacatcagcacgcctgctagtcgtagtaagttgtttaggtagttttattagttgtacagtactagttacttaagtacgttacgtccttaccgtactacgtttcggaccgtaacgggacgtacgtcgtaggtacgacgtaacgaacgtacgtggtagctcgcctacg

SEQ ID NO: 17067 - DNA, 551 bp, Homo sapiens
  misc_feature: GYAE6OF01ETO61.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaanagccaccctctcctgcagggccagtcagagtgttagcagcgacttagcctggtaccagacaaaaacctggaccaggcctcccaggcctcctcatctagtggcgcactccaccacgggccactgatactccagccaggttcagtgcaggtggtctgggacagtacttcactctcaccatcagcagcctgcagtctagtaacgtattttggtattttattattgtactagactagtaattaatacgttcgtccctacgtaacctacgtttcgggaccgtaaggggtaccctaaggtcgtaggaacgtacgtaaccgaaaacgtacgtaggttacggctggacctaaccg

SEQ ID NO: 17068 - DNA, 531 bp, Homo sapiens
  misc_feature: GYAE6OF01EOGN6.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccagggggaaanacgccaccctctcctgcaggccagtcagagtgttagcagcgacttagcctggtaccagcaaaactgccaggctccagctcctcatctatgcgcatccaccagggccacgtgatactcccagcctaggttcagtggcagtggtctgggacagattcactctcaccatcagcagcctgcagtctagtaagtagtttaggagttttaattagttgttcgaacgtcgtaaagttataaacgttaacgtacggtacccttaccggttaccgtacgtttttaccgggg

SEQ ID NO: 17069 - DNA, 562 bp, Homo sapiens
  misc_feature: GYAE6OF01CFOFZ.53.54.E10.1.454.CMB.1.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagagccacctctcctgcagggccagtcagagtgttagcagcgacttagcctggtaccagacaaaaacctggccaggctcccaggctcctcatctatggcgcactcccaccagggcccactgatactcccagccaggttcagtgcagtggtcngggacagattcactcncacatcagcagcctgacacgtctagtaagtagttttggtaagttttactttaagttgttacagtacgtagttaattaagtaacttggtacccttccgttacgttacgttttggacccgtaggggaacctaaggtctagggacgtaactacgaaaaccgtacgttaggtacgggtacctgcccgtaaacccg

SEQ ID NO: 17070 - DNA, 599 bp, Homo sapiens
  misc_feature: GYAE6OF01DLAYM.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaagacgcccaccctctcctgcagggccagtcagagtgtagcagcgacttagcctggtaccagacaaaaccgtggccaggcctcccgaggcctcctcatctatggcgcactccaccgacgggccactgatactccagccgaggttcaggtcggctaggtggtcgtgggacagtattcactctacaccatacagcagtcctgacagtctaggtaagttagttttggttaagttttattagtttgtactaagtactaagttaattaaacgttaacgttacggtacccttaccggttaacgttaccgttttacgggacccggtaacggggaacccgtaaggtcgttagggaacgtactaaccgaaaacgtacgtacggtggtacgtcgtaccgtaacccg

SEQ ID NO: 17071 - DNA, 525 bp, Homo sapiens
  misc_feature: GYAE6OF01CZFS3.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctcccagagatcattggagaaaatagtgatgacgcagtctccagccaccctgtctgtgtctccagggggaaangccaccctctcctgcagggccagtcagagtgttagcagcgacttagcctggtaccagacaaaacctggccaggcctccgaggctcctcactctagtggcgcactccaccgacgggccactgactactcccagccaggttcaggtcggcgtaggtcgggtcgtgggacagtaacttcacgtctcacatcagcagccctgctagtctgaagttatttcgacttagtttagttactgtacagctaagtactaactactggtacctccggtcgtaccggg

SEQ ID NO: 17072 - DNA, 581 bp, Homo sapiens
  misc_feature: GYAE6OF01DKQ7P.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaacngccaccctctcctgcagggccagtcagagtgttagcagcgacttagccgtggtaccagacaaaaaccgtggaccaggcctcccgaggcctcctcatctatcggcgcactcccaccgagggcccactgactactcccagccgaggttcagtcggctaggtcgggtcgtacgggactaggtaacttccgacttcctaccaccactcacgcacgtcctaggctacgttctagtaagttagttttaggtagttttaagttacgtttcgtactaggtactaagttattaaacgtaacgttacggtacccttacccggttactccggttttaaccggg

SEQ ID NO: 17073 - DNA, 744 bp, Homo sapiens
  misc_feature: GYAE6OF01DB1QC.53.54.E10.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagngatcattgganaaatgtgatgacgcagtcctccagccaccctgtcctgtcgtctaccggaaggggtaacncgcccaccctctccgtgcgacgggccagtcgagtagtgttagcagcgtacttagccgttacggaccaacgaaccaaaaccgtcggacccacggcctacccgacggtcctcctactacttacgtacgtcggaccgtacaccgtacccgaccggaccgggccctaacgtggtaaccttaccgtacccgacggtcccgtaacggttacgagggttcggacgttaggggttcgggtacgtacgggaaccgtaagttaaccgtttaccgtaccgtaccttaacccgactaacgttccgaacgtaccgaccgttccgtacgtaccgttacgttaccggttaggttaaacggttaacggttttttaggtaacgttttacgttttaacgtttacggtacgtaaccggttacttaaacgtttaaacgttaaacgtttacccggtacgggttaccccctttaaccggttttaaccgtaccgggtttttaaccccgggg

SEQ ID NO: 17074 - DNA, 554 bp, Homo sapiens
  misc_feature: GYAE6OF01EVMCK.53.54.E10.1.454.CMB.1.raw
  modified_base (250)..(250): a, c, t, g, unknown or other
  misc_feature (250)..(250): n is a, c, g, or t
  modified_base (338)..(338): a, c, t, g, unknown or other
  misc_feature (338)..(338): n is a, c, g, or t
  modified_base (506)..(506): a, c, t, g, unknown or other
  misc_feature (506)..(506): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagcccaccctgtctgtgtctccagggggaaancgccaccctctcctgcaggccagtcagagtgttagcagcgacttagcctggtaccagaccaaaactggccaggctcccgaggcctccncatctatggcgcactcccacgacgggcccaacgtcgactactcccagcccgtaggttccgaagtcggcgaggttcgggtcgtgggacagtaattccgactcctcaccatacgacgcacgccgtagcctagtctaggaagttagtttacggtagtttattagttcgtanagtcaagttataacgttactcggtacccttcgttactacgtttacggg

SEQ ID NO: 17075 - DNA, 644 bp, Homo sapiens
  misc_feature: GYAE6OF01BZ3ND.53.54.E10.1.454.CMB.1.raw
  modified_base (208)..(208): a, c, t, g, unknown or other
  misc_feature (208)..(208): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctccgaaggggaaanacgcccaccctctcctgcagggccagtcagagtgtagcagcgacttagcctggtaccagacaaaacctggccaggctccgaggcctcctcatctagtcggcgcactcccaaccgacgggccacgtcgactactccccagacctaggttcaggtggctaggtcgggtacgtgggaacctaggtaacttccgacttctaccgacctagtccaaggccaacggtccctagaccgtagtcgttacgtaaggtttagttttagggtatttttaagttagtttacgtacgtaagtaccgttaagttaaattaacgtaacgttcggtacccttaccgttaacttacggtttacgggacccgtaaggggaccctaaggtccgtaagggtacgtaacgtaacccgaaaaggttaccgtagggtacggtaccgtgacccgtaaccg

SEQ ID NO: 17076 - DNA, 542 bp, Homo sapiens
  misc_feature: GYAE6OF01ACN8C.53.54.E10.1.454.CMB.1.raw
  modified_base (207)..(207): a, c, t, g, unknown or other
  misc_feature (207)..(207): n is a, c, g, or t
  modified_base (415)..(415): a, c, t, g, unknown or other
  misc_feature (415)..(415): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaangccaccctctcctgcagggccaggtcagagtgttagcagcgacttagcctggtaccagacaaaactggccaggctcccaggcctcctcactctactggccgcactccaccgacgggccactgactactccgacgccaggttcagtggcaggtggtctgggacagtattcactctcaccatcagcacgtcctagctacgtctgtaagtntttggattttatagttgtacagtacagttataacgtagtcgtccgtcgtactcgtttccggacgtacggggacctaaggtcgtaggtacgactaacgaaacgtacgtacgtaggctcgtacgtaccg

SEQ ID NO: 17077 - DNA, 534 bp, Homo sapiens
  misc_feature: GYAE6OF01CZDDJ.53.54.E10.1.454.CMB.1.raw
  modified_base (252)..(252): a, c, t, g, unknown or other
  misc_feature (252)..(252): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagcgcgtatacacacgaccggtgctcgatttagatcgtagcagaacacacaaaagggcacgaccggtgctcgatttagatcgtagcagaacacacaagggggaggaactgctcagttaggacccagacggaaccatggaagccccagcgcagcttctcttcctcctgctactctggctcccagagatcattggagaaaatgtgatgacgcagtctccagcccaccctgtctgtgtctccgagggggaaangccaccctctcctgcagggccagtcagagtgttagcagcgacttagcctggtaccagacaaaacctggccaggctccagctcctcatctancggcncactccaccacgggccacgtcgactactcccagccgaggtttcaggtggcgaggtgggtcgtgggacagacttcactctcacatcgagcacgcctgctagtctgaagttgttttaggagttttattagttcgtacagtcgtaagtaataacgttacgtacggtccttaccgtacttcgtttacggg

SEQ ID NO: 17078 - DNA, 577 bp, Homo sapiens
  misc_feature: GYAE6OF01EOYNR.53.54.E10.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccacctgtctgtntctcgaggggaaancgccaccctctcctgcagggccagtcagagtgttagcagcgacttagcctggtaccagaccaaaaaccgtggaccacggcctcccgacggcctcctcactctagtcggccncactcccgaccgacgggcccactcgactactcccagcccgtacggttcacggtcggcgtaggtcgggtcgtgggactagtaattcactctccaccntcagcacgcctgacngtccgtagtaacgttagttttaggtagtttatttagtttcgtactacggtctaagttaagtaacttaaccgtcggtacccttaccggttacttaccggttttacgggg

SEQ ID NO: 17079 - DNA, 535 bp, Homo sapiens
  misc_feature: GYAE6OF01EZ6ZG.53.54.E10.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (439)..(439): a, c, t, g, unknown or other
  misc_feature (439)..(439): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattggagaaatagtgatgacgcagtctccagcccaccctgtctgtntctccgaggggaancgccaccctctcctgccagggccagtcagagtgttagcagcgacttagcctggtaccagcaaaaacctggaccaggcctcccgaggcctcctcagtctagtcggcgcactcccaccgacgggcccactgactactcccagcccgtaggttcagtggcagtgggtctgggacagattcactctacaccancacgacacgcctgactagtctagaagtgtttaggtatttattagttgtactagctaagtataacttacgtcgtacctccgtacgtcgtttaccggg

SEQ ID NO: 17080 - DNA, 564 bp, Homo sapiens
  misc_feature: GYAE6OF01CQTUS.53.54.E10.1.454.CMB.1.raw
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctcccagagatcattggagaaaatgtgatgacgcagtctccagccacctgtctgtgtctcgaggggaaanagccaccctctcctgcgacgggccaagtcagtacgtgttagcagcgacttagcctggtaccagacaaaacctggccaggcctcccaggctcctcatctancggcncactcccacgacgggccactgactactcccgagacccgtaggttcgagttcggactaggtcgggtcgtaggggacaaggtaacttccacgttcctcacctatcaacgctagccctgctacgttctagtaacgttagtttggtattttagttagtttcgtatacgtctaagttaataacgttaacgtacggtccctacgttactcgtttacggg

SEQ ID NO: 17081 - DNA, 592 bp, Homo sapiens
  misc_feature: GYAE6OF01DFTD0.53.54.E10.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (438)..(438): a, c, t, g, unknown or other
  misc_feature (438)..(438): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgnagtctcagccacctgtctgtacgtctccgaagggggaaancgccaccctctcctcgcagggccagtcagagtgttagcgagcgacttagcctggtaccagacaaaacctggaccaggcctccgaggctcctcatctagtgcgacnctccacgacgggccactgatactcccagcccgtaggttcagtggctaggtgggtctagggacagtaactcactcctacacancgcacagacctgactacgtcgtaggaacgtttagttttagggtaagttttaagttagtttacggttacgacgttacggtaaacgttaaattaaacgttaaaccggttcggttaccccgttaccggtttaaccgttaccgggtttttaacccggg

SEQ ID NO: 17082 - DNA, 501 bp, Homo sapiens
  misc_feature: GYAE6OF01D0W5Q.53.54.E10.1.454.CMB.1.raw
  modified_base (205)..(205): a, c, t, g, unknown or other
  misc_feature (205)..(205): n is a, c, g, or t
  modified_base (470)..(470): a, c, t, g, unknown or other
  misc_feature (470)..(470): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagcaaaaacctggccaggctcccaggctcctcatctatggcgcatccaccagggccactgatatcccagccaggttcagtggcagtgggtctgggacaggaattcgactctcaccatcagcagcctgcagtctgaagtattttggagttttattattgtcagtctagtattaatactgcctccgtactacttttggcctaggggaccagntggagatacaaacgtactgtaggctgctacc

SEQ ID NO: 17083 - DNA, 539 bp, Homo sapiens
  misc_feature: GYAE6OF01A7S8P.53.54.E10.1.454.CMB.1.raw
  modified_base (250)..(250): a, c, t, g, unknown or other
  misc_feature (250)..(250): n is a, c, g, or t
  modified_base (485)..(485): a, c, t, g, unknown or other
  misc_feature (485)..(485): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagcccaccctgtctgtgtctccagggggaaangccaccctctcctgcagggccagtcagagtgttagcagcgacttagcctggtaccagcaaaaacctggccaggctcccaggctcctcatctatggcgcactccgaccacgggccacgtgactactcccagccaggttcaggtggcaggtcgggtctgggacagtaacttcgactcgtaccacatcagacacgcctagccagtctagagtagtttaggtagtttagttagttcgtnaggtctagtaacttaacgtaactggtacccttaccgtacgtacgttttaccggg

SEQ ID NO: 17084 - DNA, 563 bp, Homo sapiens
  misc_feature: GYAE6OF01CGPNQ.53.54.E10.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctctgctactctggctcccagagatcattgganaaatgtgatgacgcagtctccagccaccctgtctgtgtctaccgagggggaaancgccaccctctcctgcgagggccagtcagagtgttagcagcgacttagcctggtaccagacaaaacctggaccacggcctccaggctcctcatctagtcggcgcactccgaccgacggccactgactactcccagccaggttcaggtggcgtaggtcggtacgtgggactaggtaacttcactctcacctactcagcacgccgtgacctagtctagtaagttcgttttaggtagttttattagttcgtagtagtacgtaagttaattaaacgttaacgttacggtacccttaccgttacgttacgtttaccggg

SEQ ID NO: 17085 - DNA, 730 bp, Homo sapiens
  misc_feature: GYAE6OF01DZ1UO.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctccagagatcattggagaaatagtgatgacgcagtctccagccacctgtctgtgtctaccgaggggaaagcgcccaccctctcctgcgagggccagtcagagttgtagcagcgtacttacgccgtcggtaccacgaaccaaaaaccgtcggaccaacggcctccccgaggtccctccgtactacttccgtagtcggccgcactcccgaaccgacgggccactcgactactcccagcctacggttacaggtggacgtaggtcgggtcgtagggacaaggtaacttcaacgttcctaccaacctactacgacgaccgtacgtccgtacgtacgtacgttcgttaggtaaagtttacgttttttagggttaagtttttagttttacgtttcgtacgtaaggttactaacggtttaaattaaaccgtttaaccggttacgggttacccctttacccggttaacgtttaccggtttttacgggacccggttaacggggtaaacccgtaaagggttaccggttaggggaaacgttaaccggtaaaccgtaaaaccgggttaacgttacgggttacggtaccgttacgccccgttaaaccgg

SEQ ID NO: 17086 - DNA, 578 bp, Homo sapiens
  misc_feature: GYAE6OF01DSTOS.53.54.E10.1.454.CMB.1.raw
  modified_base (208)..(208): a, c, t, g, unknown or other
  misc_feature (208)..(208): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggagaaatagtgatgacgcagtctccagcccaccctgtctgtgtctccagggggaaanagccaccctctcctgcagggccagtcagagtgtagcagcgacttagcctggtaccagcaaaaacctggccaggctcccaggctcctcatctatggcgcatccacagggccactgatatcccagccaggttcagtggcagtgggtctgggacagaattcactctcaccatcagcagcctgcagtctagtaaagtattttgggtagttttaatttaatttggttcaaggtactaaggttaattaaattaaacgtgggtacccttacccggttaacacgtttttagggcccgtaaaggggggaacccaaaggccgttagggaacgtaacttaacaaaaacggtaaacttcggtagggtactggctaaaccccg

SEQ ID NO: 17087 - DNA, 668 bp, Homo sapiens
  misc_feature: GYAE6OF01CGOGA.53.54.E10.1.454.CMB.1.raw
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
  modified_base (385)..(385): a, c, t, g, unknown or other
  misc_feature (385)..(385): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctccagagatcattggagaaatgtnatgacgcagtcctcacgccacctgtctgtcgtctaccgaggggaancgccaccctctcctcgcgacgggccagtcgaggtagtgttacgcgacgcgtacgttacgcctacgggtaccaacgtaaccgaaaaccgtcggaccgacgggcctaccgacggtcctaccgtacactctacgtcggcncacgtccgaccgacgggaccacgtacgtactactacccgacgtacctacggtttcgacggtcgggaccgtaaggttcggggtacgtacgggaactaacggtaacttccgtacttccgtacacctatcgacgtacgacgtcgtcgtcgacgttacgtacggtaagttagttttacgggtagttttacttacggttcgttacgtacggtaacttaacggtttaattaacgttaaaccggttccggttaaccctttacccggttaccgttaacgggtttacccggg

SEQ ID NO: 17088 - DNA, 578 bp, Homo sapiens
  misc_feature: GYAE6OF01A0YQR.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaancgccaccctctcctgcagggccagtcagagtgttagcagcgacttagcctggtaccagacaaaaccgtggccaggcctccgaggctcctcatctatcggcgcactccaccgacgggccactcgactactacccacgcccgtaggttccgacggtcgggcaacggttgggtcgtaggggactaaggtaacttccgactctaccaccatcgagcacgtccctgacctagtctagtaagtagttttaggtagttttaattagtttcgtacaggtactaagttaataacgttaacgtacggtaccttacccggttacgttacgttttaccggg

SEQ ID NO: 17089 - DNA, 595 bp, Homo sapiens
  misc_feature: GYAE6OF01D5RAG.53.54.E10.1.454.CMB.1.raw
  modified_base (164)..(164): a, c, t, g, unknown or other
  misc_feature (164)..(164): n is a, c, g, or t
  modified_base (246)..(246): a, c, t, g, unknown or other
  misc_feature (246)..(246): n is a, c, g, or t
  modified_base (367)..(367): a, c, t, g, unknown or other
  misc_feature (367)..(367): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttccnctgctactctggctcccagagatcattggagaaatgtgatgacgcagtctccagccacctgtctgtgtctacgaggggaacncgccaccctctccgtgcgacgggccagtcagtagtgttagcgagcgtacttacggccgtaggtaccagaccaaaaccgtcggaccacgggacctccgaggcctcctctacgtctagtcgcncgtactccgaccgacgggccacgtacgactacgtacccacgcccgtaggttaccgaggtcggacgtaggtcgggtcgtacgggactaggtaacttcactcctaccactagtcacggacacgcgtagcgtagtcgtagtaagttcgtttaggttacgtttattacgttgtactagtctagttaactaacgttacgtacggttacccttacgttacgttcggttaccggg

SEQ ID NO: 17090 - DNA, 685 bp, Homo sapiens
  misc_feature: GYAE6OF01D0XNH.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtcgtctacgaggggaaagacgcccaccctctcctgcgaggccagtcagagtgttagcagcgtacttacgccgtaggtaccacgaaccaaaaaccgtcggacccgacggcctaccccgacggtcctcctaccagttccgtagtcggccgactacgtcccaaccgacgggccctacgtacgactactcccgacgccgtaggttcaggtggacgtaggtcggtcgtgggactagtaacttcgacttcctaccgaaccactacgacgtaccgaacgtcctgacgtacgttcgtagtaacgttagttttaggtaagtttttagttagtttacgtcgtaaggtacttaagttaaagtaacgttaaccgttacggttacccttaccgttaaccttaccggtttacggacccggtaaagggggtaaccctaacgggtacgtagggaacgtaacgtaaccgaaaaccggtacgttacggttacgggtacctacggtaccctaacg

SEQ ID NO: 17091 - DNA, 728 bp, Homo sapiens
  misc_feature: GYAE6OF01BRC5C.53.54.E10.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatagtgatgacgcagtctccagccacctgtctgtgtctccgaggggaaancgccacctctcctgcacgggccagtcagagtgttacgcagcgacttagccgtggtaccacgacaaaaaccgttcggaccacgggcctacccgacggtcctcctctactcttaacgtcggccacctacgtacccgaacccgacggggacccctaacgtacggaacttaccgttaccccaaggtacccgtaggtttaccgaggtcgggtaccgtacgggttcggggtacttcgggggaacctaaggtaacttccgtaacttccctaccgtaacctaccgttacaacggtccgtaacgtccccgttaggtaccgttaacggttccgtaaggtaaaccggtttagtttttacggggttaaagtttttaacgttttaacgtttacggttaaccgtggttaaccgttaaagttaaacgttaaacgtttaaccggtacggttaaccccgtttaccggttaaaccgtttacccggttttaacccgggg

SEQ ID NO: 17092 - DNA, 807 bp, Homo sapiens
  misc_feature: GYAE6OF01E1S68.53.54.E10.1.454.CMB.1.raw
  modified_base (268)..(268): a, c, t, g, unknown or other
  misc_feature (268)..(268): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaacgccccaggcgcagcttctcttcctcctgctactctggcctcccagagatcagttgggaagtaaataggtgatgaccgcacgtctccagccccaccttggtcctgtcgtctaccggaagggggaaacncgccaccctctcctcggcgacgggccagtcaggtacgtgttagcgagcgacttacgccgtacggtaccacgacgaaaaccgtcggaccacggcctaccgacggtccttccgtactacttcgtacgtcggcgtaccgtactacccgaaccgacggggtacccacgtacggacttaccgtacccgacggtacccgtacgggttaccgaacgggtcgggtacgtaacggggttcggggttacggtacggggaaccgtaacggttaaccgtttacccgaacccgttacccttacccggtaaccctaacgtaccgtaacggacccgtaacggtaccccgttacggtacccggttaaccggtttaaccgttaaacggttaaacggttttacggttttaacgggtttaaacgtttttaaacgttttaacggtttacggttaacgttaacggttaacccttaaaggtttaaaccgttaaacgtttaaaccggttccggttaacccccgtttaccggtttaaccgtttacccggttttaacccggggg

SEQ ID NO: 17093 - DNA, 796 bp, Homo sapiens
  misc_feature: GYAE6OF01DZBSK.53.54.E10.1.454.CMB.1.raw
  modified_base (207)..(207): a, c, t, g, unknown or other
  misc_feature (207)..(207): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaancgccaccctctcctgcgacgggccagtcagagtgtagcagcgtacttacgccgtcggtaaccacgaaccaaaaaccgtcggaccgacggcctacccgacggccttcctctactcctagtcggccgcactcccaccgtacgggacctacgtacgactactcccgacgtaccgtagggttcaggtcggacgtagggttcgggttacggtacggggtaacgtaaggtaacttaccgtaaccgtttcctacccgtaaccctaacgttcccgaacgtccgtaacccgtccgtacgaccgtaacggttacgtaaggttaaaacggtttacgttttttaggggtttaattttttaacgttttaacgtttacggtacgttaaacggtaaccgttaaaggtttaaactttaaacgttaaaccggttaccggttaccccgttacccggtttaacgttaacccggtttttacggggaaccccgggttaaacggggtaaccccgaaagggttaccgggttacgggtaaacggtaaaccgttaaacccggaaaacggtaaccggttaggggtacccgtaaccggttcgaacccgttaacccg

SEQ ID NO: 17094 - DNA, 616 bp, Homo sapiens
  misc_feature: GYAE6OF01ALTFT.53.54.E10.1.454.CMB.1.raw
  modified_base (209)..(209): a, c, t, g, unknown or other
  misc_feature (209)..(209): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggaagaaatagtgatgacgcagtctccagcccaccctgtctgtgtctccgaaggggaaancgccaccctctcctgcacggccagtcagtagtgtagcagcgtacgttacgccgtacggtaccaagaaccgaaaaaccgtcggaccaacgggcctaccccgaggtccctcccgtacacttcgtacgtcggccgcacctcccgaaccgacgggcccacgtgactacctcccgacgtccgtacggttcgagtcggcgtaggtggtcgtaggactagtactcactcncacancagcacgcctgactagtctagtacgttgttttagtagtttattactggtactacgtatattaagtaacgtacgtcgtaccgttaccgtagttaccggtttcggaccggtacgggactacggtgtaacgggtactaaccgaacgtaaaccgtacgtcggttacgacgtcgaaccgtaccg

SEQ ID NO: 17095 - DNA, 603 bp, Homo sapiens
  misc_feature: GYAE6OF01A19M5.53.54.E10.1.454.CMB.1.raw
  modified_base (208)..(208): a, c, t, g, unknown or other
  misc_feature (208)..(208): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggagaaatagtgatgacgcagtctccagcccaccctgtctgtgtctccgaggggaaancgcccaccctctcctgcagggccagtcagtagtgttagcagcgacttagcctggtaccagacaaaacctggccaggcctcccgaggcctcctcgatctatggccgcactcccaccgacgggccacgtgactactcccagccaggtcagtggcgaggtggtcgtgggacagaatcactctcacctatcagcacgcctgcctagtctaggtaagttgttttagggtacgttttaatttagtttacgtactacgtacgtagttaacttaacgttaacgttcggtacccttaccgttaacttaccggttttcggacccggtaacggggtaaccctagggtacgtagggtaacgtacgtaaccgaaacgtacgtacggtacggtctacggtccgtaaccg

SEQ ID NO: 17096 - DNA, 807 bp, Homo sapiens
  misc_feature: GYAE6OF01BEOTR.53.54.E10.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcatgganaaatgtgatgacgcagtctccagcccacctgtctgtntctcgagggaancgccacctctctgcgaggccagtcagtagtcgttagccagacgtacttacgccgtacggtaccacgtaacaaaaccgtcggaccgaacgtccgtacccgaacggtcctacccgtactacctaccgtaagtcggaccgtactaaccgtccccgaacccggtacggggtaccctacgtacgtaacttaacccgtcccgtaacggtcccggttaacggtttccgaacgggttcgggtaacccggtggggttaacggggtccggttaacggggtaacgttaacgggtaacctttaccgtaacccgttcccgtaacccgtaaccctaaggtaccccgtaacggtaacccgtaacccggttccccgtacgggtaacctacggtttaacccgtaaggttaacggtttaaccggtttttaaggtttaaccggtttttaaaagttttacggttacggtttacctaacgggttaacgtttaaacggttaaaacgtttaaaccgttaaaccggttaccgggtttaaccccgtttaaccgttttacgggttaaaccccggttttaaaccggggg

SEQ ID NO: 17097 - DNA, 650 bp, Homo sapiens
  misc_feature: GYAE6OF01AEZ9L.53.54.E10.1.454.CMB.1.raw
  modified_base (254)..(254): a, c, t, g, unknown or other
  misc_feature (254)..(254): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggcctcccagagatcattggaataaatagtgatgacgcagtctccacgcccacctgtctgtcgtcgtaccgaaggggaanccgcctaccctctccgtcgcgacggccagtcagtaggtgtacgcagccgtacttacgccgtacggtaccaagaaccgtaaaaccgtggacccgacggtccctcccgacggtccctccgactactcgtagtcggccgtacacctacccgaaccgacggaccctacgtacgacttaccgtacccgacgtccgtacggttccgaggtcggtactagggttccggtacgtacgggaactaacgtacttccgtacctcctacctaactccgtacgaccgcctacgtcctaggtactgtaccgtagttaaggtttcgtttagttacgtttattagtacgtagtacgtacgtaaattaactaacgttacgacggttacccttacgttaccgtttgttaccggg

SEQ ID NO: 17098 - DNA, 671 bp, Homo sapiens
  misc_feature: GYAE6OF01BQCTN.53.54.E10.1.454.CMB.1.raw
  modified_base (251)..(251): a, c, t, g, unknown or other
  misc_feature (251)..(251): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctctgctactctggctcccagagatcattggagtaatgtgatgacgcagtctccacgccaccttgtctgtcgtctaccgaaggggaaancgccaccctctccgtgcgagggccacgtcgacgagttgttagcagcgtacgttacgaccgtggtaccgaacgaccaaaaaccgtcggaccgacggtccctccgacggtccttacctacgtactacgtacgtcggtccgacacctaccgaaccgacggtacccacgtacgtactacctaccgacgtccgtacggttacgacggtcggtcgtacgggtcgggtcgtacgggacgtaacgtaacgttcctaactccgtaccgaccgtacgtccgacgacctacggcccgtagtcgtacgttacgtacggtaacggtttagtttaggttagtttttaatacgttttcggtacgttagtacgttaaacgttaattaacgttacgtaccgttacccgttcgtttaaccgttacggtttaaccgggg

SEQ ID NO: 17099 - DNA, 586 bp, Homo sapiens
  misc_feature: GYAE6OF01B5TYQ.53.54.E10.1.454.CMB.1.raw
  modified_base (250)..(250): a, c, t, g, unknown or other
  misc_feature (250)..(250): n is a, c, g, or t
  modified_base (280)..(280): a, c, t, g, unknown or other
  misc_feature (280)..(280): n is a, c, g, or t
tcagcgcgtatacacacgaccggtgctcgatttagatcgtagcagaacacacaaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtctccagccaccctgtctgtgtctaccgaggggaaancgaccaccctctcctgcgaggccagtcagngtgtagcgagcgtacttcgcctacggaccaagaacctaaaaaccgtggacccgaggtccctacccgacggcctacctctactctacgtcggcacactcccaacgacgggccactgactactccgagccgtaggtcacggtcgacgtaggtcgggtctagggacagtactcactctaccactatccaagctacgccgtgacgtacgtcgtagtaacggttagttttaggtattttaacgttagttcgtacaaggtctaagttaataacgttacgtcggtaccctcgttaacgttcggttacccgggg

SEQ ID NO: 17100 - DNA, 593 bp, Homo sapiens
  misc_feature: GYAE6OF01E1C9H.53.54.E10.1.454.CMB.1.raw
  modified_base (207)..(207): a, c, t, g, unknown or other
  misc_feature (207)..(207): n is a, c, g, or t
  modified_base (347)..(347): a, c, t, g, unknown or other
  misc_feature (347)..(347): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccgagggggaaanacgcccaccctctcctgcgagggctagtcagtagtgttagcagcgactagcctggtaccagacaaaaaccgtggaccacggcctccccgaggcctcctcactctagtggcgcactcccaccgacggggccactgactacncccacgcctaggttcagtggcaggtggtcgtgggacagacttcactctcaccatcagcagtcctgctacgtctagtaagttgttttaggtattttagtttattgtactagtataagttaattaaacttaacggttccgtacccgttaccgttaaccgtacgttttcgggaccgtaacggggtaacctaacggtcgtacgggaacgacgtaaccgaaacgtacgtggtacggtctcgtccgtaaccg

SEQ ID NO: 17101 - DNA, 808 bp, Homo sapiens
  misc_feature: GYAE6OF01CA0DC.53.54.E10.1.454.CMB.1.raw
  modified_base (198)..(198): a, c, t, g, unknown or other
  misc_feature (198)..(198): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcagttgganaaatgtgatgacgcagtcctccacgcccacctgtctgtcgtctaccggaaggggaacgcgcccaccctctccgtgcgacggccagtcagtagtgtagcagtcgtacgttcgccgtacgtaccaacgaaccgaaaaccgtcggaccgacggtcccgtacccgacggtcctacccgtactactacgtacgtccgggccacctaaccgtaccccgaaccgaccgggtaccctacgtacgtaaccttaccgtaaccccgaacggtacccggttaacggttccgtaacgggtcgggtacggttacggggtttaccgggtacggtaacggggtaacctaaggtttaaaccgttaccgtaacccgttaccgttacccgaacccttaacgtacccgaacggtacccgtaccggtacccgtacgtacccgttaacggtttacggtaacggttaaaggttttaagggttttaacgggtttaaacgttttaacggtttacggtttacgtaacggttaacggttaacgttaaaacgtttaaacgttaaacgtttaacccgggttacccggtttaaccccgtttaacccggttttaaccgtttaaccggggtttaacccgggg

SEQ ID NO: 17102 - DNA, 763 bp, Homo sapiens
  misc_feature: GYAE6OF01CBFN3.53.54.E10.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccagtggaacgccccagcgcagcttctcttcctcctgctactctcggcctccagagtatctagttggaanaaatgtgatcgacgcagtctaccagccaccgtgtctgtcgtcctacggaaggggaacncgcctactacctcctccgtacgccgtacgggaccgtagtacgacggtaggttgtacgacgacgtaccgtacgttaccgtccgtacggtaacctaacgtaaccgtaaaaccgtcgggtacccacggtcccgtacccgacggtccttaccgtactacgttacgtacgtcggtaccgaccgtaccgtcccgaaccggtaccgggacctaacggtacgaccgttacctacccggacggtaccgtacggttaccgtacggtcggtacgtagggtcgggttacgtacgggtaactaacgtaacttaccgtaaccgttactacctaacctaacgtccgtaacggtacccgtacggtacccgtaccggtacgttaccggttacgtaaggttacgtttaaggtttacggttaacgttttaacgttagttaccgtacgttacggtacgtaaagtttaacttaaacggttaccggtccggtttaacccgttaacccgttaacgtttaacccggg

SEQ ID NO: 17103 - DNA, 753 bp, Homo sapiens
  misc_feature: GYAE6OF01C6N8L.53.54.E10.1.454.CMB.1.raw
  modified_base (273)..(273): a, c, t, g, unknown or other
  misc_feature (273)..(273): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggcctcccagagatcagttaggaataaatagtgaatgaccgctaagtctaccacgtcccaccgttgtccgtgttacgtacctaccggaaagggggaaanaccggacccacccctccgttcccgtcggacgacgggaccctacggtaccgagtacggttacggttaacggcgaacggtaccgtaccgtttacggccgtacggtaccgaacgaaccgtaaaaaccgtcggacccgacgggtaccctacccgaacggtcccttaccgtacctagtacgttacgtacggaccgacaccgtaccgaaccgtacgggaccctacgtaacgtaactacccgttacccgacgtacccgtaaggttcgtagggtcggacgtacggttcggggtacgtaggggaaccaaggtacttacctacctacgtaccaactacgtacgtacaccgtacgcctacgactacggttcgtaggtacgtttagtttacggtaagtttacttaggttcgttaagacgtacgttaacggttaaattaaacgttaaccgtccggttaacccttaccggttactttaaccgggttttaccggg

SEQ ID NO: 17104 - DNA, 666 bp, Homo sapiens
  misc_feature: GYAE6OF01EF6OQ.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccacctgtctgtgtctccgaggggaaancgccaccctctcctgcacgggccagtcagtagtgttagcaggcgacttagcctggtaccagacaaaacctggaccaggcctcccaggcctcctcatctagtggcgcactccaccgacgggccactgactctccgacgccgtaggttcgaggtcggacgtagggtcggtcgtacgggactaggtaacttcgtactccgtaccacctactaccgacgaccacgtccgtcgacgtacgttcgtaggtaagttagtttttcggtaagtttttacgttagtttcgtacgtacgtacgttagttaacttaacgttaacgttcgggtacccttaccggtttaccgttaccggttttacgggacccggtaacggggtaaccctaacgggttacgtagggtaacgtaaccgttaccggtaaaaaccggttaccggttacgggtacggtaccgttcggacccgttaacccg

SEQ ID NO: 17105 - DNA, 814 bp, Homo sapiens
  misc_feature: GYAE6OF01C7AO8.53.54.E10.1.454.CMB.1.raw
  modified_base (448)..(448): a, c, t, g, unknown or other
  misc_feature (448)..(448): n is a, c, g, or t
  modified_base (806)..(806): a, c, t, g, unknown or other
  misc_feature (806)..(806): n is a, c, g, or t
tcagcgcgtatacacacgaccggtgctcgatttagatcgtagcagaacacacgaaaggggggaggaactgctcagttaggacccagacggaaccatggaagcccagcgcagcttctcttcctctgctactctggctccagagatcagttaggaagaaatagtgatgacgctagtcctccacgcccacccgttgtcgtgtcgtccgtaccggaagggggaacacgccctaccctccttccgtcggacggacgggcctaggtccgaaggtaggttaggttaacggacgacggtaccggtaacgttaccggaccgttacgggtaaccaaacggaaccctaaaaccggtcggaccggacgtcccgtaccggacggtcctacctctactacgtacgtcggtaccgactacccgtacccgaccggacgggtacctaccggtacgaccgttaccnccgtaaccgtccgtacggtcgacgggttcggacggtacgggttcgggtacggtacggtacgtaaggttaaccttaccgtaaccgttcccgtaacctaaccgtacttaccgaaccggtccgtaacggtccgttacggtaacgtacgtttacggtaaggttaaggtttaggtttttacgtaagtttttagttacgttacggtaacgtacttaacgttaagttaacgttaacggttaaccgtccgttaaccgttaccggttaaccggtttccggtttaccggaaccgggttaacgggaacccgtacgggtacggttaacggacgtaaacgtaacgtaaacggtcgtaggtcgacggttacncgtaaccg

SEQ ID NO: 17106 - DNA, 975 bp, Homo sapiens
  misc_feature: GYAE6OF01DVQQ0.53.54.E10.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
tcagcgcgtatacacacgaccggtgctcgatttagatcgtagcagaacacacgaaagggggagaactgctcagttaggacccagacggaaccatggaagcccagcgcagcttctcttcctcctgctactctggcctccagagatcattggagaaatgtgatgacgnagtctccacgcccacctgtctgtgtctaccggagggaancgccacctctccgtgcgaggccagtcagagtgtagcagctactacgcctacggtaccacgtaaccaaaaccgtcggaccgacggtacctaccccgacggtcccttcctactacgttaccgttacgtacgggcccgaccgtaccgaaccccgaacccggtaaccggggacccctaaaccgttacggtaaccttaacccgttaccccgaacggtaccccggttaacgggttaccggtacggggttaccgggtacggtaacggggtttacgggggttaccgggttacgggggaaaccgtaaacggtttaaacccttacccggttaaccctttcccgtaaacccgtaaccccgtaacgttaccccggtaacgtaaccccggtaaccgtaccccgggtttacgtaaccggtaacgtttccgggttaaaaggttaaaccggggttttttaagtttttacggggtttttaacgttttttaaacgtttttaacgtttggtttaaccggaaacgtttaaccggtttaaaagttttaaacggtttaaaaccgtttaacccgggtttaacccgggtttaccccgtttaaccccgggttttaaaccgttttaaacccgggttttacccggggaaacccgggttaaaaccgggggtaaacccgtaaacgggggttacccgggtaacgggttaaacgggttaaaacccggttaaaccgaaaaacccgggtttacgttaacccggggttacgttaacccggttccgtaaaccccgttaaacccgg

SEQ ID NO: 17107 - DNA, 833 bp, Homo sapiens
  misc_feature: GYAE6OF01C9SVJ.53.54.E10.1.454.CMB.1.raw
  modified_base (240)..(240): a, c, t, g, unknown or other
  misc_feature (240)..(240): n is a, c, g, or t
tcagcgcgtatacacacgaccggtgctcgatttagatcgtagcagaacacacaaagggcacgaccggtgctcgatttagatcgtagcagaacacacaagggggaggaactgctcagttacggacccagacggaaccagtggaagccccagcgccagtcttctcttcctcctgcctactctggctccagacgatcattggaagtaaatgtgatgacgcagtctccagccaccctgtcttgngttcctaccgaggggaacgcgacccacccgtctccgtgccgacggggcctacgtcgaaggtacgtggttacgccgacggtaccgtaccgttacggccgttacggtaaccctaacggtaaaccaaaaacccggttcggacccgtaacggtcccgtaccccgaacggtccctacccttacgtacttaccgttacggtcggtacgaccctacgtaccccgaaccggtacggggtacccaaccgttcggtaacctacccgtaccccgaacggttacccgtacgggttacgtacgggtccggtacgtcgggttacgggttccggtacgggtacaacgtttaaccgttaccgtaccgttcccttaacccggtaaccctacgtttacccgaacggtttaccccaacggttaccccgttacggtaccgtacggtttacccgaggtttaaaggtttaccggttttttaaggttacgggtttttaatttacgggttttctaaccggttacgttaacgtttaaacgtttaacgttaaaacggttacccgttaacccgggttaccctttaaccgggttaaccccgtttaggtttaaccccggggg

SEQ ID NO: 17108 - DNA, 672 bp, Homo sapiens
  misc_feature: GYAE6OF01DG3W9.53.54.E10.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (389)..(389): a, c, t, g, unknown or other
  misc_feature (389)..(389): n is a, c, g, or t
  modified_base (543)..(543): a, c, t, g, unknown or other
  misc_feature (543)..(543): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaacgccccagcgcagtcttctcttccncctgctactctgctccagnatcatgganaaatgtgatgacgnagtcctccagcccacctgtcctgtctcgtacgaagggaancgcccaccctctccgtgacgcggcagtcgagtagtcgtagcagccgtacgttacgccgtacggtaacccaacgaaccaaaaccgtcggaccgtacggacctacccgaggtccctcgtccacttcgtacgtcgacgcctaacncccgtacccgacgggaccctagtacacgtacctacccgaacgtccgtacgtacgtacgggtacgcggtagggttacgggtacggtagggaacctaacggttaacttaccgaccgttacctacccgtaccagttacgacgaccgtacgaccgttnacgtacgttcgtaacggtagtttacgttttaggttatttacgttagttaccgtagtacggtaacttagttaaataaaccgttacggttaaccgtcccttaaccggttaccgtttaccggttaacccggg

SEQ ID NO: 17109 - DNA, 646 bp, Homo sapiens
  misc_feature: GYAE6OF01DOSQS.53.54.E10.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctccagagatcattgganaaatagtgatgacgcagtctccagccaccctgtcctgtcgtctaccgaggggtaacncgcccacccgtctccgtgccgacggccagtcagagtgttacgcagcgtacttcgcgtacggtacaacgtacaaaaccgtcggaccacggcctcccgaggcctcctctactctagcggtcgactacgtaccaccgacggacccactcgactacgtacccgacgtaccgtacgggttactaacggtcgggtacgtagggtcgggtacgtacggggactaagggtaacttacccgtacgttcctaacgacccttactacgacgactacggtccctcggacgtacgttcgtagtaacggtttatttagggtatttattacggttgtactaggacgtaaagttaacttaaaacgtccgtttacggtaccctttaccggtccgttaacggtttacccgggg

SEQ ID NO: 17110 - DNA, 653 bp, Homo sapiens
  misc_feature: GYAE6OF01DLKN5.53.54.E10.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
tcagcgcgtatacacacgaccggtgctcgatttagatcgtagcagaacacaccaaagggcacgaccggtgctcgatttagatcgtaggcagaacacacaagggggagaactgctcagttaggacccagacggaaccatggaacgccccagcgccagccttctcttcctcctgctactctggcctccagnatcattggganaaaatgtgatgacgctagtcctccagccctacctgtcctggtgtctacgaaggggacncgccacctcgtcctgacgacggccagtcagacgtcgtacgcagtcgacttacgccgtacggtaaccacgaacaaaacccgtcggaccgacggccctaccgacggcctacctcacttcgtatcggacgacctaacgtacccgaaccgccgggaccaacgtgactactcccgacgtaccgaggttcacggtcgggtacccgagggtcgggtcgtacgggtaactacgttaaccgttccgaccttcctaccgaacctacgtacgaccgtaccgaccgtcctacgacgttacgttacgttaggtaacgtttacgtttaggttaacgtttacttacgttacgtacgtagtactaacgttaagtaacgtcgtacgtccgttacgtacgttcggttaccggg

SEQ ID NO: 17111 - DNA, 762 bp, Homo sapiens
  misc_feature: GYAE6OF01BETRJ.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctactactctggctcccagagatcattggagaaatagtgatgacgcagtctccagccaccctgtctgtcgtctccgaggggaangcccacctctcctgcaggccagtcagtagtgttagcagcgacttagcctggtaccagaccaaaaccgtcggaccacggcctcccgacggcctaccctctactctacgtcggccgactacgtacccgaccgacggggaccctacgtcggaactaccgtaccccgaacgtacccgtaggggtttacccgacgggttacgggacccggtacgggttacgggggttaccggtacgggggtaaacctaacgggttaaacgtttacccgtaaccgttacccttaccgaaccctacgttaccgaacggaccgtaacggtaccccgtcgtaccggtacggttaccgttaacggttaaacggtttacgtttttaacgggttaacgtttttaacgtttacgtttacggttaccgttaacggttaacggtaacggttttaacgttaaaacgtttaacccggttacgggttaccccgtttacccggtttaaaccgtttacccggtttttaccgggaaaccccgggg

SEQ ID NO: 17112 - DNA, 651 bp, Homo sapiens
  misc_feature: GYAE6OF01AKWGW.53.54.E10.1.454.CMB.1.raw
  modified_base (258)..(258): a, c, t, g, unknown or other
  misc_feature (258)..(258): n is a, c, g, or t
tcagcgcgtatacacacgaccggtgctcgatttagatcgtagcagaacaccacaaaggggcacgaccggtgctcgatttagatcggtagcagaacacacaagggggaggaactgctcagttaggacccagacggaaccatggaagccccagcgcagcttctcttcctcctgctactctggcctcccagagatcattggaagaaaatagtgatgacgcagtctccagccacctgtctgtgtcctaccgagggggaaacncgccctaccctctccgtggccagggccagtcgagacgtgttagcagcgtactacgcctggtaccagaccaaaacctggccaggtcctccgaggcctcctctactctatcggcgtcctactcccaccgacgggcccacgtcgactactaccacgtcctaggttcgaaggttcgggactacgggttcggggtcgtacggggtacgaagttaacttcctaccttctaccgacccacgtaccgacgacctacgtacccgtgtcctaaggttcccgtaaggtaagttacgtttacgggttaacgttttagttaacgtttcgtacgaacggttccgtaagttaacttaaacgttaacgttcggtacccgtttaccgtaaccgttaccgttttaaccggg

SEQ ID NO: 17113 - DNA, 720 bp, Homo sapiens
  misc_feature: GYAE6OF01CGO2C.53.54.E10.1.454.CMB.1.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagcgcgtatacacacgaccggtgctcgatttagatcgtagcagaacacacgaaagggggaggaactgctcagttaggacccagacggaaccatggaagccccagcgcagcttctcttcctcctgctactctggctcccagagatcattggaagaatgtgatgacgcagtcctccacgccaccctgtctgtgtctcggaaggggaancgccacctctcngcgaggcagtcagngtgtagcacgtcgacttacgccgtacggaccacgaacaaaaccgtcggaccgacggtaccctacccgaggtcccttacctatactacttaggaccgggcctaccgtaccttaccccggaaccggaccggggacctaacgtacggtaactaccgtaccccgacggtaccgtaagggttcgaggtcgggacgtagggtcgggtccggtaaggacgtaacgtaacgttccacttaccgaccaacgttagaccgtacggtacaccgtcgtagacgtacgtagttaaggttaacgttaagttttggtaagtttttaacttggttaacgtcgtaacgtacgttaagttaaccggtttaacttaaacccggtccgttaacccggtttacccgtaacgtttaccgggttacggaaacccgggtacggtaaacccgtgtacggacggtaactaacgtaccgtaaacggtcgttagaccgtcgtacgcgtaacccg

SEQ ID NO: 17114 - DNA, 852 bp, Homo sapiens
  misc_feature: GYAE6OF01EYOAZ.53.54.E10.1.454.CMB.1.raw
  modified_base (197)..(197): a, c, t, g, unknown or other
  misc_feature (197)..(197): n is a, c, g, or t
tcagcgcgtatacacacgaccggtgctcgatttagatcgtagcagaacacacaaagggcacgaccggtgctcgatttagatcgtagcagaacacacgaagggggagaactgctcagttacggacccagacggaaccagtggaacgccccagccgcagtctttctccttcctcctgctactctcggcctcccagagtntacgtagttaggaagtaaaattggtagatcggaccgtcacgtcctccacgtccctacccgtgtctcggtcgtccgtaccggaaggggaaacaccggtccctaccctccgtaccggtcggaccgacgggtacctaggtacgtagtacggttacgtacggcgacggtacgtacgttacggcccggtaggtaacccaacgtaaaccgaaaccggtcggacccgtacggtacccgtacccgacggttcccttacctactaacgttacgtacgtcggacctaccgtaccgtacccggaaccggaccggtaccctaacgtacgtaaccttacccgtcccggtaaccgttaccgggtacggttacgtacgggtccggtaacggtacgggttcgggtacgtacgggtaaccgtagtaaccttaccgtacccgtttacaccgtacctacgtacccgtacggtacgtaccggtccgtagtacccttaacgggttaacgtttacggggttaactttttacggggttaacgttttacggttttaagtttacgtaccggttaacgtacggttaaagttaaaccggttaaacgtttaaacccggttacccggttacccggttaaacccgttttacccgggtttaaccgttccggggtttaaacccgggg

SEQ ID NO: 17115 - DNA, 864 bp, Homo sapiens
  misc_feature: GYAE6OF01AWUAJ.53.54.E10.1.454.CMB.1.raw
tcagcgcgtatacacacgaccggtgctcgatttagatcgtagcagaacacacaaagggcacgaccggtgctcgatttagatcgtagcagaacacacaaggggagaactgctcagttaggacccagacgaaccatcggaagccccagcgctagctttcgtcttcctcctgccttactctggcctcccagacgatcattgggactaaatcgtgatggaccgcagtcctccagccctacctgtcctagtcgtccgtaccggaagggggtaaactcgaccctacccgttccgtaccgtcggaccgacggggtacccacggttccgtaacggtacggttacggtttaacggcccgtaacggtaccggttaaccgtttaacggcccggttacggttaacccgaaaggtaaacccgtaaaaaccgttccgggaacccgaccgggtaccccttaccccggtaacggtaccctttccccgttactaaccgttccgttaacgtcccgggtcctaccgtacccgtaccggaacccggaacgggtccccgtaacgtaccgtaacgttacccgtaccccgtaacggtacccgtaacgggtttaccgtacggttaccgggtaccgtacgggtttaccgggtaccggttaacgggtaccttaaacggttaaacgtttcccgtaaccgttaccgttaccgtaacctacgttaccgaaccgtaccgtaacgtcccgtacggtaccgttacggtacgtttaacggtaaggtttcgttttaacggttacttttacggtttacgttacgtacttaacggtcttaacgttaacttaacgttaacgttcgttaacccgttcgtttaaaccggttccgtttaccggg

SEQ ID NO: 17116 - DNA, 678 bp, Homo sapiens
  misc_feature: GYAE6OF01DZ1JP.53.54.E10.1.454.CMB.1.raw
  modified_base (255)..(255): a, c, t, g, unknown or other
  misc_feature (255)..(255): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagctttctcttcctcctgctactctggcctcccagacgatcattggaagaaatagtgatgacgcagtctccagccaccctgtcctgtcgtctccgaggggaaacncgcccaccctctccgtgcgacggccagtcgagtagtgttagcagtcgacttcgcctcggtaccagaaccaaaaccgtcgaccgagccctccgacggcctccgtacacttctagtcggcgactactccgaacccgtacgggcccacgtagtaactacctacccgacggtaccctacgggttacaacgggttcgggacgtacggggttcgggtacgtggggaactaagtaaccgtttcaccgtacctaccgaacctacgttacacgacgacgtcccgtagaccgtacgtacgttagaaacggtttagtttttacggtaaagtttttacgtttaagttacggttatacgtaacgttaagttaacttaaaccgtttaacgttccgggttacccttacccggttaaccgttaacggttttacccgggg

SEQ ID NO: 17117 - DNA, 761 bp, Homo sapiens
  misc_feature: GYAE6OF01CA6JF.53.54.E10.1.454.CMB.1.raw
  modified_base (296)..(296): a, c, t, g, unknown or other
  misc_feature (296)..(296): n is a, c, g, or t
tcagcgcgtatacacacgaccggtgctcgatttagatcgtagcagaacacacaaagggcacgaccggtgctcgatttagatcgtagcagaacacacgaagggggagaactgctcgagttacggacccagacggaccagtggaacgccccagcgcagtccttctccttcctcctgtcctactcgtcggcctcccaagagtactcagttaggaacgtaaagtaggtagatcggaacgctagtcctaccgacgtcccctacctgtccgttgtcgtaccgtaccggaaaggggtaaaccncgtaccctaccctctccgtgaccgtacggacctagtaccgaaggtgtcgtacgcgagaccgtaagtcgtactacggtaccaacgtaacctaaacgtcgacgtacgtaccgtaccgacggtcctacctacgtactacgtaagccggtcctaactaccctacccgtaaccggaccggtacctaacgtactaacgtacccgtaacccgtacggtaccgttacggtccggacgtccgggtagtacggggtcggtaacgtacggtaaccgttaagaccgtttacctaccgtcctactacccgtattaacgaccgtcctaacggtccgtacgtacgttacggttagtaagtaacggtttaggttttagttaaccttttagtaccggttaagttaccgaagttaacgttaggttaaactacgttaaccggtaccttaccgtttaacccgggttgtttaaaccccggtccggg

SEQ ID NO: 17118 - DNA, 687 bp, Homo sapiens
  misc_feature: GYAE6OF01EY5FG.53.54.E10.1.454.CMB.1.raw
  modified_base (275)..(275): a, c, t, g, unknown or other
  misc_feature (275)..(275): n is a, c, g, or t
  modified_base (423)..(423): a, c, t, g, unknown or other
  misc_feature (423)..(423): n is a, c, g, or t
  modified_base (562)..(562): a, c, t, g, unknown or other
  misc_feature (562)..(562): n is a, c, g, or t
tcagcgcgtatacacacgaccggtgctcgatttagatcgtagcagaacacacaaagggcacgaccggtgctcgatttagatcgtagcagaacacacgaaggggagactgctcagttagacccagacggaaccatggaacgccccagcgcagtcttctcttcctctgctactcgtcggcctccagagatcgtagttggaataaatgtgtagtcgacgctacgtcctcccgacgccctacccgttgtccgttgttcgtccgtaccggaaggggaacnccgccctaccctctccgtcgcgacggacctagtcgagtaggtcgttagcgacggtacgtacgttacgccgtacggtaaccgacgtaacccaaaccgtcgaccgacgtacccgtccgacgtcctaccgtactactcgtacggtcgaccnccgtacctcccgacgaccgaccgtacgtacgtacctacgtacccgtacgtaccggtacggtacgtaggtaccggtacgtgggttcggtacggtacggtaacgtaacgtaacgttcccgtaccttccaaccgtacctacncgacgacgtaccgcgtacgtcgtacgttacgtaggttaagttgtttagttacgtttattagttcgtagtacgattacgttaattacgtacgttacgttacccttacgttacggttcgttaccggg

SEQ ID NO: 17119 - DNA, 625 bp, Homo sapiens
  misc_feature: GYAE6OF01APPQ1.53.54.E10.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
tcagcgcgtatacacacgaccggtgctcgatttagatcgtagcagaacacacaaagggcacgaccggtgctcgatttagactcgtagcagaacacacaagggggaggaactgctcagttaggacccagacggaaccatggaagccccagcgcagcttctcttcctcctgctactctggctcccagagatcattgganaaatagtgatgacgcagtctccagccacctgtctgtgtctccgagggggaaancgccaccctctcctgcagggccagtcagagtgttagcagcgacttagcctggtaccagacaaaaacctggccaaggcctcccgaggcctcctcatctagtcggcgcactcccaccgacgggcccacgtcgaactactcccgagcccgtagggttcaacggtcgggaccgtaggttcggggtacgttaggggaacctaaggtaacttccgtaaccttcctaccaacctacgttaccgaacgccgacgcccgtggaccgtagttccgtaggtaacgttagttttagggtaagtttttattagtttcgtatacggtcttaaagttaattaaacgttaacgtcggttacccttaccgttacgttaccggttttaccggg

SEQ ID NO: 17120 - DNA, 706 bp, Homo sapiens
  misc_feature: GYAE6OF01EGKBV.53.54.E10.1.454.CMB.1.raw
tcagcgcgtatacacacgaccggtgctcgatttagatcgtagcagaacacacaaagggggaggaactgctcagttaggacccagacggaaccagtggaagccccagcgcaggcttctcttcctcctgctactctggcctcccagagatcattggagaaatagtgtattgacgcaagtctccagccacctgtctgtcgtctccgagggggtaacacgtcccaccctctcctcggcgtacgggtccagttcagtaggttgttaagcagcgtacttacgcctcggtaccagacctaaaaccgtgaccagtcctaccgacgtctcctacacttactagtcggccgacactcccaccgacggaccctacgtgactacctccacgtacctacggttcacggtcggacgtagggtcgggtcgtacgggactaaggtaacttccgacgttcgtaccgaaccgtacgtacgacgtcgacgtacctacgctacggttactaaggtaagttaggttttagggttaattttaagtttattcgttagagttactaaggttaacttaaacgttaacgtcgggttaaccccttacggttaacccgttacggttttaccgggacccgggtaaacggggtaacctaaacggggtacgttaacgggaaacgttaaccgttaaaccgaaaccggtacgtacggtacggtacgtcgactaaacccg

SEQ ID NO: 17121 - DNA, 774 bp, Homo sapiens
  misc_feature: GYAE6OF01A6QCB.53.54.E10.1.454.CMB.1.raw
  modified_base (210)..(210): a, c, t, g, unknown or other
  misc_feature (210)..(210): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcagttggaagaaatagtgatgacgcagtctccagcccaccctgtctgtgtcctccgaaggggaanacgcccaccctctccgtgcgacgggccagtccaggtagtgttacgcaggtaccgtacgttacgccgttacgggtaacccaagtaacccgtaaaaaaccgtcggacccgtacggtcccttaccccgaccggtcccttccgtactacttaccgtaacgtcggtccgactaccgtacccaccgacgggaccctacgtacgtaacttaccgtacccgaacgtccgtaacgggttacgaaggtcggtacgtacgggttcggttacgtacggggtaaactaaggtaaccttacccgtaaccgttacctacccgtaaccctaactaccgaacgtaccgaacggtccgtacgaccgtagttaccgttaaggttaaacggttggtttttaaggttattttaacgtttacgtcgtacgaacgtacgttaaagttaacttaacgtaccgttacgttacccttaccgttacgttaccgttaccggaccggtaacgggtaacccgtagtacccggtaggtaactaaccgtaaaccggaaacgttacggtacggtaccgacgtccgtaccgtaacccg

SEQ ID NO: 17122 - DNA, 604 bp, Homo sapiens
  misc_feature: GYAE6OF01DGW0B.53.54.E10.1.454.CMB.1.raw
  modified_base (206)..(206): a, c, t, g, unknown or other
  misc_feature (206)..(206): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaancgccaccctctcctgcagggccagtcagagtgtagcagcgacttagcctggtaccagacaaaaacctggccaggcctcccaggcctcctcatctagtggcgcactcccaccgacgggccacgtgactactacccagccgtaggttccaggtcggcgtagggtgggtccgtggggaacaaggtaattcactctaccaccatcgagcagtcctgctagtctagtaacgttagttttggtattttagttagtttgtcgaagtctaagttaattaagtaacgtcggtacccttaccgttacgttacgttttcgggaccggtacggggaaccctaaagggtcgtagggtaaacgtaacgttaaccgaaaacgtacgttaggtaccggtactcggacctaaccg

SEQ ID NO: 17123 - DNA, 821 bp, Homo sapiens
  misc_feature: GYAE6OF01D06JU.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccacctgtctgtgtctcgaaggggaaancgcccaccctctccgtggcgacgggccagtcaggtagtgtacgcagtcgtacttacgccgttacggtaccaagaaaccaaaaccgtcggaccgacggcctacccgaggtcctcctctactctagtcggcacactacccgacgacgggtcctacgtacgactaccgtacccgacggtacccgtagggtttacgaacgggttccgggtacggttaacggggttcggggttaccgggtacgggggtaaaccgtaacgggttaaaccgtttaccctacccgtttacccttaccaaacccgtacgtacggacgtaccgtaaccggtccgtacggaccgtacggttacgttaagggttaaacgttttacggtttttaacgggttaagttttttaacgtttaaggtttacgttaacgtaacggttaacgttaaacggttaaatttaaacggttaaccggttacccggttaaccccgttttaacccggtttaacgtttaccgggttttaaccgggacccgggttaaacgggggtaacccctaagggttaccggtaacgggtaacgtaaacggttaacccgtaaaacggttacggttacgggtacgtacgtacggccctaaacgg

SEQ ID NO: 17124 - DNA, 904 bp, Homo sapiens
  misc_feature: GYAE6OF01C1GTV.53.54.E10.1.454.CMB.1.raw
  modified_base (143)..(143): a, c, t, g, unknown or other
  misc_feature (143)..(143): n is a, c, g, or t
tcagcgcgtatacacacgaccggtgctcgatttagatcgtagcagaacacacaaagggcacgaccggtgctcgatttagatcgtagcagaacacacgaagggggagaactgctcagttaggacccagacggaacagtggaacnccccagcgcagcttctcttcctctgctacgtctcggcctacccagagtacttcgtagttgggaactaaaagtggtgaagtcgaacccgtcgaacggttccctaccgaacggtacccctaccccgtggttaccgttaggttccgtttaccgacccggggtaaaggggggtaaaccaccgtaccccgtaaccccgttcgttacccggtacggtccgaacgggtccctaacggtcgacggtaacgttgttaacgacaacggtacgttaacgttaccgacgtacggtaaccgacgaaaccgtaaaaccgtcggaccgtaacggcccgtaccgacggtaccttacctacgtacgttacgtacggacgtaccggactaccgtacccgtaaccggtcgggaacccttaacgtacgtaacgtacccgtaccgaccggttacccgtagggtttaccgacggttacgggacggttcgggttaacgggtcggttaacggggtaccttaaacggtaccgtttacccgaaccgttttaccgtaacccgtaaccgtaccgtacggtaacgtacccggtacgttcccggtaagttaccgttacggttaacgttacggttaaacgttttagggttttaccgtaacggttttacgtttaacggttaccgttaggtaacccgtttaaaggttaaccgtttaaacgtaaccccggtttaacggttaccccggtttaaccggtttaccccggttaaagtttttccccggggtaaacccggg

SEQ ID NO: 17125 - DNA, 905 bp, Homo sapiens
  misc_feature: GYAE6OF01E4IZ0.53.54.E10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctcccagagatcattggaanaaatgtgatgcgcagtcctccagccctacctgtctgtcgtctccgaagggggaacncgcccaccctcctccgtcgacgacggaccacgtacgacggtaggttagttacgacgtacggacggtaactttacgtccggttacggtaccgtaacgaaacccgtaaaaaacccggtcggtacccgtaccggtcccgtacccccggtacggtcccttaccccgtacttacgtaccgtacggttcggaccgtaccgaccgtaccccgaacccgaaccggggtaccctaaccggtaccgtaaccttaaccgtaccccgaacggtacccggttaacggtttaccgtacgggttacggtacggttaaccggggttacggggttaccggttaacggggaaccttaaacggtttaaacccgttttcccgtaacccgttaccccttaaccctaaccccgttactaccgtaacccggttaccgacccggacccgttaacggtacccttaacggttacgtttaaaccgggtaaagtttttacggggtttttacgggtttaaacgttttttaaaccggttttaactttacccgggtttaacgttaaacggttaaccgttaaacggttttaaaaacctttaaacggttttaaaccccggttacggggttaaccccccttttccccgggtttaaaacccgtttcccgggtttttaaacccgggggg

SEQ ID NO: 17126 - DNA, 816 bp, Homo sapiens
  misc_feature: GYAE6OF01CLPQV.53.54.E10.1.454.CMB.1.raw
  modified_base (494)..(494): a, c, t, g, unknown or other
  misc_feature (494)..(494): n is a, c, g, or t
tcagcgcgtatacacacgaccggtgctcgatttagatcgtagcagaacacacaaagggcacgaccggtgctcgatttagatcgtagcagaacacgacgaagggggagaactgctcgagttacggacccagaccggaaccagtaggaacgccccagcgcacgtcctttcctccttcctcctcgccttacgtcgtcggacctaccgagagtatacgtagttaggaagtaagtgtacgtatacgaccgctacgtcctaccacgacccgtaccgttgtcgtcgttcgtaccgtacggaaggggtaacaccgccctacccttccgtcgtcggaccgacggtccacgtacgaggtgtcgtacgacgtagtacgtactcgtccgtacgaaccaacgaaccaaacggtcgacccgtacgtccgaccgtacgtcctacctacgtactcgtacgtcgacgtcctaccgacccgaacggaccgtactaacgtcgtaacgtacccnccggaccgttacgtaggttaaccgtgggtacgtggtaccgggttcgggactagggtacctaacggttacctccgtactcccgtaacaccgttagaccgtaccggtaccgaccggttcccgtacgtaaccgttcgggtttaacgttaacggtttacggtttttaaacggttttagggtttaaacccttttaggttttaccggtaaacccgttaggttaaacgtttaaaccggtttaagtttaaacccgttaccggttaccggttaaccccggtttaccccgtttaacccggtttttacccggttaacggggttaaaccccggg

SEQ ID NO: 17127 - DNA, 788 bp, Homo sapiens
  misc_feature: GYAE6OF01EOAEL.53.54.E10.1.454.CMB.1.raw
tcagcgcgtatacacacgaccggtgctcgatttagatcgtagcagaacacacaaagggggagaactgctcagttaggacccagacggaaccatggaagccccagcgcagcttctcttcctcctgctactctggcctccagagatcattggagaaatagtgatgacgcagtctccagcccaccctgtctgtcgtcctaccgaaggggaaactcgaccaccctctcctggcgacgggccagtcagtagtgttagcagccgtacttacgccgtacggtaaccacgaacctaaaaaccgtcggaccgacggtcccacccgacggtccctacctctattccgtagtcgggcaccactcccgaaccgaccggacctacgacgtactaccgaccctacggaccgttacggtactacgggtcggtacgtacgggttacggggtctacgggggactaaacggtaccgtttaccaccgttacccttaccaacccgtaacgtacgaccgtaaccggtcgtacccgtagtaccgtagttaccgttaaggttaagtttaacgggtttttaagttagtttttaagttttagttacgttaaccgtaggtaacgttaacgtttaaacgttaaacgttaacccgttaccggttaacccggttacccgtttaaaccgttaccgggttttaccggggaccggtaaaccggggtaaacgtaacggtacgggtaacggtaaggtaaccttaaacccgggtaaaaacgttccggtaagggttacccggtacgtcggtaacccttaacccg

SEQ ID NO: 17128 - DNA, 771 bp, Homo sapiens
  misc_feature: GYAE6OF01AFN5G.53.54.E10.1.454.CMB.1.raw
  modified_base (70)..(70): a, c, t, g, unknown or other
  misc_feature (70)..(70): n is a, c, g, or t
  modified_base (477)..(477): a, c, t, g, unknown or other
  misc_feature (477)..(477): n is a, c, g, or t
tcagcgcgtatacacacgaccggtgctcgatttagatcgtagcagaacacacgaaagggcacgaccggtnctcgatttaggatcgtagcagaacacgacgaagggggagactgctacgtagttacggacccagacggaaccagtggaacgccccagccgcacgtcttcctccttcccgtcccagtcctactcgtcggtaccacccgaggactctactagttggaagtaaatggtgaacttggaccgtacacgttccgaccctagccccttaccgtgttcgtggttactaccggtaccggaaggggaaactcccgaaccctaccctccgtccgcggaccggacggtccaggtacgaggtcggttacggtaacgcgtacggtaccgtaacgttccgtcgtaccggtaccgtaacgaacccggtaaaccgtccggaccggactcccgtccggacgtccacctcgtacttcgacgtccgcnccgtaacgtcccgaacggtccgactacggtatcccgtaccgtaccctacggtaccgtacgttccggtacggtacggtacggtcgggttacggacggtaacggtaactccgtaacgttcctacccgtaccgtaacccgtacgtacgcgtacggacccgtacgacgttccgaacggttactacggtacttaacgtttgttacggtttaccttagttaccggttagtacgtttaggagttaaccgtaaacgttccgtaaacgttcctaccgtttccttaaccgggttcgtaaacggg

SEQ ID NO: 17129 - DNA, 703 bp, Homo sapiens
  misc_feature: GYAE6OF01CQGYC.53.54.E10.1.454.CMB.1.raw
  modified_base (214)..(214): a, c, t, g, unknown or other
  misc_feature (214)..(214): n is a, c, g, or t
  modified_base (420)..(420): a, c, t, g, unknown or other
  misc_feature (420)..(420): n is a, c, g, or t
tcagcgcgtatacacacgaccggtgctcgatttagatcgtagcaggaacacacaaagggggagaactgctcagttaggacccagacggaaccatggaagccccagcgcagcttcgtcttcctcctgctactctggcctcccagtgatcattggaagaatagtgatgacgcagtcctccacgccaccctgtcctgtcgtctaccgaggggaaacncgccaccctcgtcctgcctgggcccagtcgagtagtgtagcagcgacttagcctggacagacaaaactgaccaggcctccaggctacctcatctagtgcgcagtccacgacggtaccacgtcggatactccacgcgtacggttcgaggtcgacgtacggtcggtacgtcgggacacggtacttcgactcgtacctacctagtaccngtaccgtacgtcctacggaccaggttccgtaagtaacggttagttttaggttaacgttttaaccgttagtttacggttaactaacggtcgttaaacgtttaacgttaaacggttaaaccgtcgggttacccgttacccggtttaaccgttaccggttttacccggggacccggttaacgggggtacccgtaaacgggttaccgtacggggtaaacgttaaacctaaaccggtaaaaccggtacggttaacggttacggaccggttaccggtacctaaacccgg

SEQ ID NO: 17130 - DNA, 787 bp, Homo sapiens
  misc_feature: GYAE6OF01ALERU.53.54.E10.1.454.CMB.1.raw
  modified_base (135)..(135): a, c, t, g, unknown or other
  misc_feature (135)..(135): n is a, c, g, or t
  modified_base (157)..(157): a, c, t, g, unknown or other
  misc_feature (157)..(157): n is a, c, g, or t
  modified_base (267)..(267): a, c, t, g, unknown or other
  misc_feature (267)..(267): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccntggaagccccagcgcagcttcncttcctctgctactctggcctcccgagagatctagttggaagtaaaatggtgaatggaccgtcacgtctccacgccaccctgtctagtcgtcctaccggaagggggaaanccgacccctacccgtccgtccgtacggccgacggggaccacggtacgaaggtacgttacggttaacgcgacggtaccggttaacgttaccgaccgttacggtaacccgaaggtaaaccctaaaaccggtcggacccgtacggacccgttacccacggtccttaccctacgtacgtccgtaacggtcggacgtacctaaccgtcccgaaccggaccgggtacctaacgtcgaaccttacccgtacccgaacgtcccgtaacggttcgaacgggttcggaacggttcgggttacgggtacgtaacgggtaacgtacggttaaccgttaccgacgtttacccgaacgttaccggtaacttacccggaccggtaacccgtaccgtaccgttacggtaaccgttacggttacccgtaaggtttaacggtttacgtttacgggtttaaagtttaccgtttaagtcgtacgtacgtactaacgtaacttaacgtactccggtaccttacgtcgttacggttaccggg

SEQ ID NO: 17131 - DNA, 858 bp, Homo sapiens
  misc_feature: GYAE6OF01B3KIJ.53.54.E10.1.454.CMB.1.raw
  modified_base (289)..(289): a, c, t, g, unknown or other
  misc_feature (289)..(289): n is a, c, g, or t
tcagcgcgtatacacacgaccggtgctcgatttagatcgtagcagaacacacaaagggcacgaccggtgctcgatttagatcgtagcagaacacgacgaagggggagaactgctcagttacggacccagacggaaccagtcggaacgccccagcgcagtcttctcttcctctgctactcgtggcctccgagagtatactagttacggaagtaaatgtagacgtgaaccgctacgtcctaccgacgcccctaccgttgtccgtggtcgtacgtaaccggaaggggaaacncccgaccctacccgttcgtccgtcggacggtacggaccgtacgtaacgtaggtacggttacgttaccgaccggtaacggtaccgttaaccgttccggtaccggttaaccgggtaacccgaaaaccgtaaacccgtaaaaacccgggtccggtaccccgggaaccggtacccctaaccccggtccggtacccttacccgtacgtaaccgttcgtaacgggtcccggtacccacccgtacccgtaaccccggaacccggtacccgggaaccttaccggttaccgtaaacccgttacccggtaaccccgtaacggtaccccggttaacggtttaccggaacgggttaccgggttacgggtaacgggggttccgggttaacgggtaaacgggtaaccttaacgggttaaccctttcccgtaacccgtcctaacccggtaaccctacggtacgaaccgtccgacgtccgtacgtacgtagttactagttatttacggttagttagtttgtacttacgacgtagtacgttacgtaacgttacgtacgtcgtacttccgttacgttcggtaccggg

SEQ ID NO: 17132 - DNA, 763 bp, Homo sapiens
  misc_feature: GYAE6OF01B9P08.53.54.E10.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagcgcgtatacacacgaccggtgctcgatttagatcgtagcagaacacacaaagggcacgaccggtgctcgatttagatcgtagcagaacacacaagggggagaactgctcagttacggacccagaccggaaccatggaacgccccagcgcagcttctcttcctctgcctactctggcctcccagnatcagttaggaanaactgtgatcgacgcagtcctccacgcccacccgttgtctgttacgtcctaccggaaggggaaacncgaccctaccctcgtacctcggaccgacggacctacggtacgaaggtacggttacgtacgaccgtaggtaccggtaccgttacggacccgttacgggtaaccctaacgaaacccgtaaaaccggtcgggacccgtaacggtcccgtaccgtaacggtccctacccgtacgtacgttacccgtaggtaccggtccgaccgttaaccgtacccgaaccggtaccggtacctacgtacgtactacccgtaccgacggtaccgtacgtaccgtaggtcgacggtcgggtacggtacgtacggaactagtaacctcctacgtccaacgtacccagttaccgagtaccggtacgtaccgttagtaccgtacggtacgtaggtacgtttacggttaaggtttaattacggtttaactccggttaagaacgttacgttacgttaaacgttacgtacccgttaccgggttacccttaccggtttaaccgtttcggttaacccggg

SEQ ID NO: 17133 - DNA, 683 bp, Homo sapiens
  misc_feature: GYAE6OF01A8GCC.53.54.E10.1.454.CMB.1.raw
  modified_base (214)..(214): a, c, t, g, unknown or other
  misc_feature (214)..(214): n is a, c, g, or t
  modified_base (488)..(488): a, c, t, g, unknown or other
  misc_feature (488)..(488): n is a, c, g, or t
tcagcgcgtatacacacgaccggtgctcgatttagatcgtagcagaacacacgaaagggggaggaactgctcagttaggacccagacggaaccatggaacgccccagcgcagcttctcttcctcctgctactctggcctcccagagatcagttggaagaaatagtgatgacgcagtctccacgcccacctgtctgtcgtcgtccgaaggggaanacgccctaccctcctcgtgcgacggccagtcgagtagtgtacgcacgcgtacgtcgccgttacggtaccagaactaaaccgtcggaccgacggtccctaccgacggtaccctacctacgtactctacggtcggaccacgtaccctaccgacgtacggacctacgtacgactaccgacccgtacggaccgttacggttacggacggtacggtacggtagggtcggtacggtacggtacgtaacgtacttaccgacttccgtacacctagtcgacncgtacgcgtcgactacgtctacggtagtttacgtttacgttaacgtttagttatacgtacgacgttaagtattaacgtaacgtaccgtacgttcccgttacttaccgttacggttaccggaccgtaccgggtacgtacggacggtacggtacttaccgaggtaaacgttcgaggtacctacggacctccgtaacg

SEQ ID NO: 17134 - DNA, 490 bp, Homo sapiens
  misc_feature: GYAE6OF02HV5F9.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagagccaccctctcctgcagggccagtcagagtgttagcagcgacttagcctggtaccagcaaaaacctggccaggctcccaggctcctcatctatggcgcatccaccagggccactgatatcccagccaggttcagtggcagtgggtctgggacagaattcactctcaccatcagcagcctgcagtctgaagtattttggagtttattattgtcagcagtataataactgcctcgtactctttggcctagggaccaaggctggagatcaagactgtggctgctacc

SEQ ID NO: 17135 - DNA, 498 bp, Homo sapiens
  misc_feature: GYAE6OF02G1XV5.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaanagccaccctctcctgcagggccagtcagagtgttagcagcgacttagcctggtaccagcaaaacctggccaggctcccaggctcctcatctatggcgcatccaccagggccactgatatcccagccaggttcagtggcagtgggtctgggacagaattcactctcaccatcagcagcctgcagtctagaagtattttggagtttattattgtcagcagtataatactgtcctccgtacactttgccgtagggaccaagtctaggagatacgaacgacgtgtaggctgctaccg

SEQ ID NO: 17136 - DNA, 499 bp, Homo sapiens
  misc_feature: GYAE6OF02IJW74.53.54.E10.1.454.CMB.1.raw
  modified_base (247)..(247): a, c, t, g, unknown or other
  misc_feature (247)..(247): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctcaggggaaangccaccctctcctgcagggccagtcagagtgttagcagcgacttagcctggtaccagcaaaaacctggccaggctcccaggctcctcatctatggcgcatccaccagggccactgatatcccagccaggttcagtggcagtggtctgggacagaattcactctcaccatcagcacgcctgctagtctagaagtatttaggagtttattagttgtcagtctagtataatactggcctcgtactacgtttacgg

SEQ ID NO: 17137 - DNA, 514 bp, Homo sapiens
  misc_feature: GYAE6OF02G6HZ5.53.54.E10.1.454.CMB.1.raw
  modified_base (247)..(247): a, c, t, g, unknown or other
  misc_feature (247)..(247): n is a, c, g, or t
  modified_base (412)..(412): a, c, t, g, unknown or other
  misc_feature (412)..(412): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaangccaccctctcctgcagggccagtcagagtgttagcagcgacttagcctggtaccagcaaaacctggccaggctcccgaggctcctcatctatggcgcatccaccagggccactgatactcccagccaggttcagtggcagtgggtctgggacagaattcactcncacatcacgcacgcctagctacgtctgaacgttagttttcggagttttattagttcgtactagtctaagtataagtactggtacctcgttactacgtttcgg

SEQ ID NO: 17138 - DNA, 504 bp, Homo sapiens
  misc_feature: GYAE6OF02HYXF9.53.54.E10.1.454.CMB.1.raw
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagagccaccctctcctgcagggccagtcagacgtgttagcagcgacttagcctggtaccagcaaaaacctggccaggctcccaggctcctcatctatggcgcatccaccagggccactgatatcccagccaggttcagtggcagtgggtctgggacaggaacttcactctcacatcacgcagcctgcagtctgaagattttggagttttattagttgtctagacagtatataactggaccctcgtacctactttcggg

SEQ ID NO: 17139 - DNA, 532 bp, Homo sapiens
  misc_feature: GYAE6OF02JCCV2.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaanagccaccctctcctgcagggccagtcagagtgttagcagcgacttagcctggtaccagcaaaaacctggccaggctcccaggctcctcatctatggcgcactccaccagggccactgactatcccagccaggttcagtggcagtggtctgggacaggaattcactctacaccatcagcagcctgcagtcctagaagtacttttaggagttttattagttgttcgagctagtattaataactggtcctaccgttactacttttggccgtacgggacctaaggtcgtaggacgtataccgaaacgtacgtgtacggctaggcctaaccg

SEQ ID NO: 17140 - DNA, 525 bp, Homo sapiens
  misc_feature: GYAE6OF02GMDVA.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagcaaaactggccaggctcccaggctcctcatctatggcgcatccaccagggccactgatatcccagccaggttcagtggcaggtgggtctgggacagaattcactctcaccatcagcagcctgcagtctgaagtagttttaggagttttattattgtcagtctagtataataactgtccttacgtactacgtttcggaccaggggtaccaaggtctagggtagacgttacgaaacgtacgtaggtacggacgttgacctaaccg

SEQ ID NO: 17141 - DNA, 511 bp, Homo sapiens
  misc_feature: GYAE6OF02I99S5.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagagcccaccctctcctgcagggccagtcagagtgttagcagcgacttagcctggtaccagcaaaacctggccaggctcccaggctcctcatctatggcgcatcccaccagggccactgatatcccagccaggttcagtggcagtgggtctgggacagattcactctcaccatcagcagcctgcagtctgaatattttggagttttattatttgtctagtcagtataatactggcctcgtactacttttcggcctacggggaccaaggctgggagatacaaacggtactggtaggctacggctaaccg

SEQ ID NO: 17142 - DNA, 555 bp, Homo sapiens
  misc_feature: GYAE6OF02IXJDP.53.54.E10.1.454.CMB.1.raw
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (345)..(345): a, c, t, g, unknown or other
  misc_feature (345)..(345): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatagtgatgacgcagtctccagccaccctgtctgtgtctccaggggaangccaccctctcctgcagggccagtcagagtgttagcagcgacttagcctggtaccagcaaaaacctggaccaggctccaggcctcctcatctatggcncatcccaccgagggcccactcgactactcccgagcccaggttcaggtcggcgaggtcgggtcgtgggactagtaattcactcctccaccatcacgcacgcctgcctacgtctagaagttattttagggtattttaattagtttgtactaagttctaagttaattaaacttaacgtcggtacccttaccggttaccttacgttttaccggg

SEQ ID NO: 17143 - DNA, 533 bp, Homo sapiens
  misc_feature: GYAE6OF02I5V8B.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagcaaaaacctggaccaggctcccaggctcctcatctatggcgcatccaccagggccactgactatcccagccaggttcagtggcagtcgggtctgggacagaattcactctcaccatcagcagcctgcagtctagtaagttagtttaggtagttttagttagttcgtactagtctaagttaacttaattaacgtcggtacccttaccggttacttaccgttttaccggg

SEQ ID NO: 17144 - DNA, 501 bp, Homo sapiens
  misc_feature: GYAE6OF02FVWT9.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagcaaaaacctggccaggctcccaggctcctcatctatggcgcatccaccagggcccactgatatcccagccaggttcagtggcagtgggtctgggacagaattcactctcaccatcagcagcctgcagtctgaagtatttggagtttattagttgtcagtctagtataatactggcctaccgtactactttaccggg

SEQ ID NO: 17145 - DNA, 513 bp, Homo sapiens
  misc_feature: GYAE6OF02FX0MX.53.54.E10.1.454.CMB.1.raw
  modified_base (247)..(247): a, c, t, g, unknown or other
  misc_feature (247)..(247): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaangccaccctctcctgcagggccagtcagagtgttagcagcgacttagcctggtaccagcaaaaacctggccaggctcccaggctcctcatctatcggcgcatccaccacgggccactgatactcccagcccaggttcagtggcagtgggtctgggacagaattcactctcaccntcagcagcctgcagtctagaagtnttttaggtatttattagtttgtactagtctagttataataacttggtccctaccgttactctttacggg

SEQ ID NO: 17146 - DNA, 511 bp, Homo sapiens
  misc_feature: GYAE6OF02F2JWD.53.54.E10.1.454.CMB.1.raw
  modified_base (247)..(247): a, c, t, g, unknown or other
  misc_feature (247)..(247): n is a, c, g, or t
  modified_base (431)..(431): a, c, t, g, unknown or other
  misc_feature (431)..(431): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaangccaccctctcctgcagggccagtcagagtgttagcagcgacttagcctggtaccagcaaaacctggccaggctcccaggctcctcatctatcggcgcactccaccagggcccactgatactccacgccaggtcagtgcagtgggtctgggacagaattcactctcaccatcagcagcctgccngtctagaagtagtttggagttttaattattgtctagtactagtaataactacgtcgtacctccgttacgtactttacggg

SEQ ID NO: 17147 - DNA, 562 bp, Homo sapiens
  misc_feature: GYAE6OF02F1LOI.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangcccaccctctcctgcagggccagtcagagtgttagcagcgacttagcctggtaccagcaaaacctggccaggctcccaggctcctcatctatggcgcatcccaccagggcccactgactactccccagcccaggttcaggtggcagtgggtctgggacaggaattcactctcaccatcagcagcctgcagtctagaagtagttttggagttttattagttgtcagtctagttaataagttaactcggtcccttaccgttaacttaccgttttggacccgtaaggggtaccctaaggtccgtagggaacgtacgtaaccgtaaaccgacgttggtacggtcctacggacctaacccg

SEQ ID NO: 17148 - DNA, 520 bp, Homo sapiens
  misc_feature: GYAE6OF02F3FLV.53.54.E10.1.454.CMB.1.raw
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatgtgatgacgcagtctccagccaccctgtctgtgtctccaggggaaangccacctctcctgcagggccagtcagagtgttagcagcgacttagcctggtaccagacaaaacctggccaggctcccaggcctcctcatctatcggcgcactcccaccgacgggccactgactactcccagcctaggttcagtggcagtcggtcgtgggacagatcactctcaccatcagcagccngacngtcngaagtagtttgtagtttatagttgtactagtactagttataacgttacgtacggtcctaccgttactacgtttaccggg

SEQ ID NO: 17149 - DNA, 552 bp, Homo sapiens
  misc_feature: GYAE6OF02JAY27.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaanagccaccctctcctgcagggccagtcagagtgttagcagcgacttagcctggtaccagcaaaaacctggccaggctcccagctcctcatctatggcgcatccaccacgggccactgatatcccagccaggttcagtggcaggtgggtctggggacagaattcactctcaccatcagcagcctgcagtctagaagtatttggtagtttattattgtcagactagtataataactcgccttacggtacttacgttttcggaccgtacggggaaccgtaaggtccgttagggaacggtacgttaacccgaaaacggtaccttagggtacggtccttaggaccctaaacccg

SEQ ID NO: 17150 - DNA, 668 bp, Homo sapiens
  misc_feature: GYAE6OF02JQ0MG.53.54.E10.1.454.CMB.1.raw
  modified_base (207)..(207): a, c, t, g, unknown or other
  misc_feature (207)..(207): n is a, c, g, or t
  modified_base (647)..(647): a, c, t, g, unknown or other
  misc_feature (647)..(647): n is a, c, g, or t
tcagcgcgtatacacacgaccggtgctcgatttagatcgtagcagaacacacgaaagggggaggaactgctcagttaggacccagacggaaccatggaagccccagcgcagcttctcttcctcctgctactctggcctcccagagatcattgggagaaatagtgatgacgcagtctccagccacctgtctgtgtctccgaggggaanacgccacctctcctgcagggccagtcagagtgtagcagcgactagcctggtaccagacaaaacctggaccacggctcccgaggtcctcctctatctatcggcgactactcccaccgacgggcccacgtcggaacttactcccgacgacccgtacggttctacggtcgggaccgtagggttcggggttaccgtacggggtaactaacggtaacttccgtaaccgtaccgtaccctaaccgtactaccgacgacctacggtcccgtgaccgtacgtaccgtacgtaagttagttttaggtaacggttttattaagtttcgttacgtaggtacttaagttaacgttaacttaaccgtacgttcccgtaaccgttaccgttacgttttaccgggaccgtaacgggtaccgtaaggtcgtaggtacgtacgtacgaacgttacgnggtagaccgtacgtacctacg

SEQ ID NO: 17151 - DNA, 516 bp, Homo sapiens
  misc_feature: GYAE6OF02GI9G5.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagcaaaaacctggccaggctcccaggctcctcatctatggcgcatccaccagggcccactgactatcccagccaggttcagtggcagtggtctgggacagaattcactctcacatcagcagcctgcagtctgaagtagtttggtatttattagttgtcgtagtctaagttataacttaacgtcggtacccttaccgttactacgttttaccgg

SEQ ID NO: 17152 - DNA, 558 bp, Homo sapiens
  misc_feature: GYAE6OF02GW60I.53.54.E10.1.454.CMB.1.raw
  modified_base (248)..(248): a, c, t, g, unknown or other
  misc_feature (248)..(248): n is a, c, g, or t
  modified_base (404)..(404): a, c, t, g, unknown or other
  misc_feature (404)..(404): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtctccagccaccctgtctgtgtctccgaggggaaancgccaccctctcctgcacggccagtcagagtgttagcagcgtactgcctggtaccagacaaaacctggaccaggcctcccgaggtcctcctcatctagtcggcgcactccacgacgggcccacgtgactactcccacgccgtaggttcagtggacnggtcgggtcgtgggactagtaattcactcctcacatcagacacgctcgctacgtctacgtaagttagtttaggtagttttagttagtttcgtactaggtactaagttaagttaactacgttcggtacccttacggttaccttacgtttaccggg

SEQ ID NO: 17153 - DNA, 532 bp, Homo sapiens
  misc_feature: GYAE6OF02IBFEM.53.54.E10.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
tcagcgcgtatacacacgaccggtgctcgatttagatcgtagcagaacacacaaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaagngccaccctntcctgcagggctagtcagatgttagcagcgacttagcctggtaccagacaaaaactggccaggctcccaggctccctcatctagtgcgcatccaccgagggccactgatacnccagccagttcagtgcagtggtctggacagatcactctcgacatcagcagcctgactagtctagaagttatttaggtatttattatgtatagactagtataatacgtcggtcctacggtactacgtttcgaccgtaacgggtaccaacgtcgtaggacgtaactaccgaaacggtaacgtggttacggcttacggcctaacccg

SEQ ID NO: 17154 - DNA, 511 bp, Homo sapiens
  misc_feature: GYAE6OF02GAQDV.53.54.E10.1.454.CMB.1.raw
  modified_base (247)..(247): a, c, t, g, unknown or other
  misc_feature (247)..(247): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaangccaccctctcctgcagggccagtcagagtgttagcagcgacttagcctggtaccagcaaaaacctggccaggctcccaggctcctcatctatggcgcatccaccagggccactgatatcccagccaggttcaggtggctagtgggtctggggacaggtaattcactctcaccatcagcagcctgcagtctgaagtatttggagtttattagttgtacagtctagttataattacgtggtaccctaccgtactacgtttacggg

SEQ ID NO: 17155 - DNA, 594 bp, Homo sapiens
  misc_feature: GYAE6OF02G89F1.53.54.E10.1.454.CMB.1.raw
  modified_base (247)..(247): a, c, t, g, unknown or other
  misc_feature (247)..(247): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctcagccacctgtctgtgtctccgaaggggaancgccaccctctcctgcagggccagtcagagtgttagcagcgacttagcctggtaccagaccaaaaaccgtggacccaggcctccccgaggcctccgtactactctagtcggcgcactacccaccgacgggccacgtgactactcccgagcccgtaggttcgagtcggcgtaggttcggggtacgtgggaacaagtaattccacttcctaccacctatcacgcacgtccgtgacgtacgtcgttaggtaagtttacgttttaggtagtttttaacttagtttcggtactaagtactaagtttaataacgttaacgtcggtacccttaccgttacttacgtttaccggg

SEQ ID NO: 17156 - DNA, 633 bp, Homo sapiens
  misc_feature: GYAE6OF02G5B90.53.54.E10.1.454.CMB.1.raw
  modified_base (251)..(251): a, c, t, g, unknown or other
  misc_feature (251)..(251): n is a, c, g, or t
  modified_base (454)..(454): a, c, t, g, unknown or other
  misc_feature (454)..(454): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattggagaaatagtgatgacgcagtctccagccaccctgtctgtgtctccgaaggggaaangcccaccctctcctgcagggccagtcagagtgttagcagcgacttagcctggtaccagacaaaaacctggaccaggcctcccaggcctcctcatctatggcgcactcccgaccgacgggcccacgtacgactactcccacgccctacgggtttcaggtcggcgaggtcgggtcgtgggacaaggaatttcacgtctacaccanccagcacgccttgacctgtctaggaaacgttagtttttgggtaacgtttttaagtttacgtttacgggtttacctaacgggtaacgttaaacggtttaaagtttaaaacgttaaccggttaccggttaacccccggtttacccggttttaaccgttacccggttttttaaccccggggg

SEQ ID NO: 17157 - DNA, 545 bp, Homo sapiens
  misc_feature: GYAE6OF02HT9Y6.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccacctgtctgtgtctccagggggaaangccaccctctcctgcagggccagtcagagtgttagcagcgacttagcctggtaccagcaaaaacctggaccaggctcccaggcctctcatctatggcgcactccaccacgggccactgactactcccagcctaggttcagtggctaggtcgggtctgggacagtaattcactcgtacaccatcacgaccagccgtgccagtcgtagaagttgtttaggtagttttatttagttcgtactacgtactaaggttataacgttaacgtacggtaccgttaccgttactacgtttaccggg

SEQ ID NO: 17158 - DNA, 731 bp, Homo sapiens
  misc_feature: GYAE6OF02JXE4Z.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtcctccagccacctgtctgtcgtctccgaggggaaancgccacctctccgtgcgacgggaccagtcacgtagtgttagcagcgtactacgccgtggtaccaggtaaccaaaaacccgtcgggacccgacgggtaccctaccccgacggtcctaccctaccgtaacttaccgttaacggtcgggacccgtacaaccgttaccccgaacccgtacggggacccctaaccggttacgtaaccgtttaccgtacccgacggtacccgtaacgggtttactaaaccgggtcggtaccgtaacgggttcggggttacggtcggggaaacgtaacggtaacgtttcccgaacccgttacctaccgtaacctacgttaccgaacgtaccgaccgtaccgtacggtaccgtacgtcgtaacggttaagttacgtttaggttacgttttagtttacgtttacggtacctagttacgttaaagtagttaacgttacggtaccgttcctacgttaccgttacgttaccggg

SEQ ID NO: 17159 - DNA, 513 bp, Homo sapiens
  misc_feature: GYAE6OF02FXQDE.53.54.E10.1.454.CMB.1.raw
  modified_base (247)..(247): a, c, t, g, unknown or other
  misc_feature (247)..(247): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtctccagccaccctgtctgtgtctccgaggggaangccaccctctcctgcagggccagtcagagtgttagcagcgacttagcctggtaccagcaaaaacctggccaggctccaggctcctcatctatggcgcactccaccgagggcccactgactactcccagccaggttcaggtgcagtggtctgggacagatcactctcacntcagcagcngcngtctgtagtntttgtatttagtagttgtactagtactagttaataacgttacgtcggtaccttaccggttactacgtttaccggg

SEQ ID NO: 17160 - DNA, 510 bp, Homo sapiens
  misc_feature: GYAE6OF02HP0QW.53.54.E10.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
  modified_base (486)..(486): a, c, t, g, unknown or other
  misc_feature (486)..(486): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctccgaagggggaaancgccacccctntcctgccagggccagtcagagtgttagcagcgacttagcctggtaccagcaaaacctggccaggctccaggctcctcatctatggcgcatccaccacgggccactgatactccagccaggttcagtggcagtgggtcngggacagaattcactcctcaccctancagcacgcctgcagtctgtaacgtatttggtatttattattgtcagtnagtattaagtactggtcctctatctttgcgtagggaccaagtctaggagactanaacgtactaggtcgctggctaacg

SEQ ID NO: 17161 - DNA, 680 bp, Homo sapiens
  misc_feature: GYAE6OF02G6UYL.53.54.E10.1.454.CMB.1.raw
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (363)..(363): a, c, t, g, unknown or other
  misc_feature (363)..(363): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattgganaaatgtgatgacgcagtctccagcccaccctgtctgtcgtctaccgaaggggaaancgcctaccctctccgtgcgacggccagtcagagtgtagcgagcgacttcgcctggtaccagaccaaaacgtggaccagcctcccgacggtcctcctacatctagtcggcncactcccaacgtacggacctacgtacgacttaccgtcccaacggcccgtaagggttccaacgggttcggaccgtagggttcggggtaccgtaggggaacctaacggtaactttacccaccgttaccctacccgtaacctagtacccgaaccgtccgtaaccgtcccgtacggtaaccgttaggttacccgtaaggttaaagtttacggttttagggtacgtttttaagttaacgttcggtaactacgtaacgttaaacgtttaagtaaccgttacggttaccgttacccgttaccgttaccgtttacgttacccggg

SEQ ID NO: 17162 - DNA, 542 bp, Homo sapiens
  misc_feature: GYAE6OF02GODA7.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttagaacccagacggaaccatggaagccccagcgcagcttctcttcctcctgctactctggctcccagagatcattggagaaatagtgatgacgcagtctccagccaccctgtctgtgtctccgaggggaangccaccctctcctgcaggccagtcagagtgtagcagcgacttagcctggtaccagacaaaaacctggacccaggcctaccccgaggcctcctcatctatcggcgcactccaccagggccactgatactccagccaggttcagtgcgagtgggtctgggacagtattcactctacaccatcagcacgcctgctagtcctagaagtagttttagggtattttagttagttcggtactaggtctaagttaattaacgttaacgtccggtacccttaccgttactacgttttaccggg

SEQ ID NO: 17163 - DNA, 735 bp, Homo sapiens
  misc_feature: GYAE6OF02GMR8P.53.54.E10.1.454.CMB.1.raw
  modified_base (202)..(202): a, c, t, g, unknown or other
  misc_feature (202)..(202): n is a, c, g, or t
tcagcgcgtatacacacgaccggtgctcgatttagatcgtagcagaacacacaagggggaggaactgctcagttaggacccagacggaaccatggaagccccagcgcagcttctcttcctcctgctactctggctccagagatcattggagaaatagtgatgacgcagtctccagccacctgtctgtgtctccgaggggaancgccaccctctcctgcagggccagtcagagtgttagcgagactagtcgcgtacgacgacaaacctaacggcgacgcgtccacggacgtcctcactctataggcggcactcctaccgacgggtacggtacctagtagtaactacccgaccgaccgacggttacgtacggtcgggtacggtacggtagggggttcggttacggggtaacggtaacgtaaacggtttactaccgtaccgttaccaccctaacttcgaaccgacgtaccgaccgttcgtacgaacggttcgtaggtaaagttacgttttttagggttacggttttaattttacgttacggtttaccgaagtaacgtaacggtttaaactttaaacgttaaaccgttcgggtcccgtttcccgtttaaacttaacgtttttcggggtacccgggaacggggtaaccgtaacccgtggtaccgggtaacgaacgtttaacccgaaaacggtaaaccggtttggttacggggtaacccgtcggtaacccacccgttaagg

SEQ ID NO: 17164 - DNA, 528 bp, Homo sapiens
  misc_feature: GYAE6OF02GARIL.53.54.E10.1.454.CMB.1.raw
  modified_base (249)..(249): a, c, t, g, unknown or other
  misc_feature (249)..(249): n is a, c, g, or t
  modified_base (349)..(349): a, c, t, g, unknown or other
  misc_feature (349)..(349): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaangccaccctctcctgcagggccagtcagagtgttagcagcgacttagcctggtaccagacaaaaacctggaccaggctcccacggctcctcatctatggcncatccaccgacgggccactcgactactcccagcctaggttcaggtggcaggtcgggtctgggactagtaattcactctcaccatcagcacgcctgcacgttctgaattagtttgattttagtattgtactagtactagtaataagtaacgtcggtaccttacgttactactttaccggg

SEQ ID NO: 17165 - DNA, 559 bp, Homo sapiens
  misc_feature: GYAE6OF02FTO7B.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctcaggggaaagngccaccctctcctgcagggccagtcagagtgttagcagcgacttagcctggtaccagacaaaaacctggccaggctcccaggctcctcatctatcggcgcatccaccgagggcccactgatactcccagccaggttcagtggcaggtgggtcgtggggacaggattccactctcaccatcagcacgcctgcagtctgtaacgtattttggtagtttattagttgtctagtactagttaattaataacgtggtaccttaccggttacttacgttttcgggaccgtaacggggtaccaaggtcgttagggagtaacgtacgaaacggtacgttaggtcggccttaggacctaaccg

SEQ ID NO: 17166 - DNA, 747 bp, Homo sapiens
  misc_feature: GYAE6OF02GJMH9.53.54.E10.1.454.CMB.1.raw
  modified_base (253)..(253): a, c, t, g, unknown or other
  misc_feature (253)..(253): n is a, c, g, or t
tcagcgcgtatacacacgaccggtgctcgatttagatcgtagcagaacacacaaagggcgacgaccggtgctcgatttagatcgtagcagaacacacaaggggagaactgctcagttaggaccccagaccggaaccatggaagcccccagcgcagcttctcttcctccgtgcgtacctctggctcccagagatcattggacaatagtgatggaccgcagtctccagccaccctgtctgtgtctccaggggaancgccacccgtactaccttgcaggccagtcagagtcgttacgcaagccgacttagccctggtaccagcaaaaaccgtggaccaggcctacccgaggcctcctcgattcctatcggacgtcacttccgaacccgtacggggaccctaaccgttggaactttacgtccccgacgtaccccgtagggtttcccaaggttcggacctagggttcgggtccgtcggggaaccgaggtaaacgtttccgaaccgtttcgtaacctaccctacgtttacgaacggtacccaacggttcccgtagtacccgtacggttaccgttacggttaaacgttagttttttacgggggtaacgttttttaacggttttaacgttttcgggttaaccgttaacggggtacccttaaacgggtttaaactttaaacggtttaaacccgtttaccgggttaaccccggtttacccggtttaacccgttacccggttttttaaaccccggggg

SEQ ID NO: 17167 - DNA, 598 bp, Homo sapiens
  misc_feature: GYAE6OF02HN881.53.54.E10.1.454.CMB.1.raw
  modified_base (248)..(248): a, c, t, g, unknown or other
  misc_feature (248)..(248): n is a, c, g, or t
  modified_base (348)..(348): a, c, t, g, unknown or other
  misc_feature (348)..(348): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaangccaccctctcctgcacggccagtcagagtgttagcagcgacttagcctggtaccagacaaaaccgtggccaggctcccgaggctccgtcatctatggcncactccaccgacgggccactcgactacgtcccagcccgtaggttacgaggtcggacgtaggtcgggtcgtagggacaggtaacttcgacgttcctccaacctactacacgacacgcctgaccgtacgtccgtaggtaaacgttagttttacgggtagtttttatttagtttcggttacgaacggttactaacggttaactaagttaaccgtccggttacccttaccggttaccgtaccgttttaccgggg

SEQ ID NO: 17168 - DNA, 834 bp, Homo sapiens
  misc_feature: GYAE6OF02IILF6.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtctccagccaccctgtctgtgtcctcgaaggggaaancgccaccctctcctgcgaggccagtcagagtgttagcagcgtactagcctggtaccagaccaaaaaccgtcggaccgacggtcctacccgaggcctcctacctactcgtaacgtcggccgactacgtaccgaccgtaacgggaccctacgtacggtacttaccgtaccccgaacgtacccgtacgggttaccgtaacgggtcgggtacgttacggggtcggggttaccggtacgggggtaaccgtaacgggttaaaccgttttacccgtaaccgtttacccgtacccgtaaacccgtaaccgtttaccggaaccggtacccgtaaccggtacccgtaccgggtaacccgttaaccggttacccgggtttaaacggaaacgggtttaacggttttttaaccggggtacggtttttttaaacgtttacggttttaaccgggtacccgttaaacgggttcccgttaaaaacgggttttaaaccgttttaaaaccgggttaaacccgggttttacccggggtttaacccccctttaacccgggggtttttaacccccgtttaacccggggtttttttaacccccggggg

SEQ ID NO: 17169 - DNA, 563 bp, Homo sapiens
  misc_feature: GYAE6OF02ISNEW.53.54.E10.1.454.CMB.1.raw
  modified_base (206)..(206): a, c, t, g, unknown or other
  misc_feature (206)..(206): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaanacgccaccctctcctgcagggccagtcagagtgtagcagcgacttagcctggtaccagacaaaaacctgccaaggctacccgaggctcctcactctatggcgcactccaccgacgggccacgtgactactcccacgccaggttcagtcggcaggtggtcgtagggacaggtaacttcgacttcgacctaccatcacgcacgtccgtagccagttcgtagtaacgtagttttaggtattttattacttagtcagtactaagtattaaagtactgtaccctacgttactacgtttacgccgaacgggtacgaacgtcgtaggactacgtacgaaacgtacgtgtaggacctgcctaacg

SEQ ID NO: 17170 - DNA, 564 bp, Homo sapiens
  misc_feature: GYAE6OF02H0T09.53.54.E10.1.454.CMB.1.raw
  modified_base (143)..(143): a, c, t, g, unknown or other
  misc_feature (143)..(143): n is a, c, g, or t
  modified_base (318)..(318): a, c, t, g, unknown or other
  misc_feature (318)..(318): n is a, c, g, or t
  modified_base (452)..(452): a, c, t, g, unknown or other
  misc_feature (452)..(452): n is a, c, g, or t
tcagcgcgtatacacacgaccggtgctcgatttagatcgtagcagaacacacaaagggggaggaactgctcagttaggacccagacggaaccatgggaagccccagcgcagcttctcttcctcctgctactctggctcccagngatcattggagaaatgtgatgacgcagtcctccagcccaccctgtctgtgtcctccgaggggaaagacgcccaccctctcctggcagggccagtcaggagtgttagcagcgacttagcctggtaccagacaaaaaccgtggccaggcctcccgacggcctcctcatctagtggcncactcccgaccgacgggccactgactactcccagccgtaggttcagtgggcaggtgggtctgggactagacttcactctcacctatcaagcagcctgctaggtctagaagtacttttagggaattttagtagtntcgagtactagtactaatacgttgtacctcgttaactacgtttcggcgtacggggtaccaaggtctagggaacgtactacgaaacgtcgtaggtcggacttggacctaaccg

SEQ ID NO: 17171 - DNA, 562 bp, Homo sapiens
  misc_feature: GYAE6OF02FYC0Q.53.54.E10.1.454.CMB.1.raw
  modified_base (207)..(207): a, c, t, g, unknown or other
  misc_feature (207)..(207): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctccaggggaaagngccaccctctcctgcagggccagtcagagtgttagcagcgacttagcctggtaccagacaaaaacctggccaggctcccaggcctcctcatctatggcgcactccaccagggccactgatctcccagccaggttcagtggctagtgggtctgggacagtaattcactctcaccatcagcacgcctgccagtcctaggaagtacgtttttgggtaacttttatttagtttggtactaggtctagttaataataacgttcggtacccttacgttacttacgttttcgggccgtacggggtacctaaggtcgtagggataacgtacgaaacggtacgtggtaggtctaggcctaaccg

SEQ ID NO: 17172 - DNA, 540 bp, Homo sapiens
  misc_feature: GYAE6OF02F8PFI.53.54.E10.1.454.CMB.1.raw
  modified_base (250)..(250): a, c, t, g, unknown or other
  misc_feature (250)..(250): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagcccaccctgtctgtgtctccgaggggaaancgccaccctctcctgcagggccagtcagagtgttagcagcgacttagcctggtaccagacaaaaacctggaccaggcctcccaggcctcctcatctatcggcgcactcccacacgggcccacgtgactactcccagccgaggttcaggtcggctgtgggtctgggactagaattcactctcaccactcacgcacgcctgcagtcgtagaagttgtttaggtatttatagtttcgtactaggtactaagtataactacgttcggtaccttaccgtacttacgtttaccggg

SEQ ID NO: 17173 - DNA, 754 bp, Homo sapiens
  misc_feature: GYAE6OF02FNQLS.53.54.E10.1.454.CMB.1.raw
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatgtgatgacgcagtcctcacgccacctgtctgttcgtcctaccgggaaggggaaacgcgaccctacccctccgttccgtcgaccggacggacctacggtacgaggaggttggtacgcgacggtccgtacgttacgtaccgtacggtaaccgaacgaacctaaaaccggtcggaccgacggtccctacccggacggtcctcccgtactacgttaccttaggtcggaccgtactaccgtcccgaaccggacggtaccctaacgtacgtactaccaccgacgtaccgtacggttcacggtacgcgtacgggttcgggtcggtacggtacgaacggttaacttccgtacgttaccgtaccaacccgtagtaccacggtaccaccggttccgttacgaccgttacggttaccgttaaaggttaaccgttttaggtttttaacgggtttagttttttaacgtagttttacggtacctaacggttacgttaacgtttaaacttaacgttaccggttaccgttacccgtttaacccgtttaccggtttacggttttacccggg

SEQ ID NO: 17174 - DNA, 581 bp, Homo sapiens
  misc_feature: GYAE6OF02HDZKN.53.54.E10.1.454.CMB.1.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaangccacctctcctgcagggccagtcagagtgttagcagcgacttagcctggtaccagacaaaacctggcaggctccagctccncatctatggcncactcccaccgacgggcccacgtgaactactcccacgccctaggtttccaggtcggtactaggtcgggtcgtgggacaaggtaacttcgacttctccaccactcagccagcctagcagtctagaagttacgttttggaagttttattagttcgtactagtacctaagttaacttaaagttacgtcggtacccttccgtaaccttacgttttcggacccgtaggggaaccaaggtcgtaggaacacgtacgaaacgttacgtggtcggacgttacgacctacg

SEQ ID NO: 17175 - DNA, 674 bp, Homo sapiens
  misc_feature: GYAE6OF02IQCV5.53.54.E10.1.454.CMB.1.raw
  modified_base (251)..(251): a, c, t, g, unknown or other
  misc_feature (251)..(251): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggaagaaatagtgatgacgcagtctccagcccaccctgtctgtgtctccgaaggggaancgccaccctctcctgcaggccagtcgagtagtgtagcgagcgtacgttacgccgtcggtaccaacgaaccaaaaaccgtcggacccgacggtaccctccccgacggtacctcccgtctaactaccgtacgtcggaccgcaccgtacccgaaccgacgggccctaaccgtacgtactacctacccacggtcccgtaacggttcgagggtcggacgtagggtcgggtacggtagggacgtaaggtaacttccgtaccttccgtaccctaacctagtaccgacggtaccgtaccggtcctacggtaccgtacgttaccgtaggtaaagtttacggttttaggttagtttttaagtttagttgttaccgtagtaccgttaagttaacttaacgtacgtacgtccctaccgttaccgttacgttccgg

SEQ ID NO: 17176 - DNA, 513 bp, Homo sapiens
  misc_feature: GYAE6OF02G8T99.53.54.E10.1.454.CMB.1.raw
  modified_base (250)..(250): a, c, t, g, unknown or other
  misc_feature (250)..(250): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaacngccaccctctcctgcagggccagtcagagtgttagcagcgacttagcctggtaccagcaaaaacctggccaggctcccaggctcctcatctatggcgcatccaccagggccacgtgatactcccagccaggttcaggtggcngtgggtctgggacagaattcactctcnccatcagcagcctgcacgtctagaagtattttggattttagttagttgtactagtcaagttataactacgtcggacctccgtactctttacggg

SEQ ID NO: 17177 - DNA, 574 bp, Homo sapiens
  misc_feature: GYAE6OF02GQ4EU.53.54.E10.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtcgtctccgaggggaaanacgccaccctntccctgcagggccagtcagagtgttagcagcgacttagcctggtaccagacaaaacctggccaggcctcccaggcctcctcatctagtcggcgcactccaccgacgggccactgactactcccagccgtaggttcaggtggacgtaggtcgggtctgggacagacttcgactcncgacatcancacgcctgccagtcgtagacgttagtttaggtattttagttattgtactaggactagttaattaatacgttcgccttacttacgttaccgtttaggaccgtaacgggtaccaaggtacgttaggaacgtacgtaacgaacgtacggttaggtacgtacgtcgaccgtaacccg

SEQ ID NO: 17178 - DNA, 515 bp, Homo sapiens
  misc_feature: GYAE6OF02GE2IN.53.54.E10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (422)..(422): a, c, t, g, unknown or other
  misc_feature (422)..(422): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatagtgatgacgcagtctccagcccaccctgtctgtgtcctccgagggggaaangccaaccctctcctgcagggccagtcagagtgttagcagcgacttagcctggtaccagcaaaaacctggaccaggctccaggctcctcatctatgcgcatccaccagggccactgatactccagaccaggttcaggtggactaggtcgggtctgggacagtaatcactcncacatcagcacgcctgctagtctagaagtagtttggagtttatacgttgtcagtctagtataatacgtcggacctacgtactacgtttacggg

SEQ ID NO: 17179 - DNA, 775 bp, Homo sapiens
  misc_feature: GYAE6OF02JWMPQ.53.54.E10.1.454.CMB.1.raw
  modified_base (318)..(318): a, c, t, g, unknown or other
  misc_feature (318)..(318): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggcctcccagagatcattggagaaatagtgatgacgcagtcctccagccaccctgtctgtgtctccgaggggaacacgccaccctctcctgcgagggccagtcaggagtgttagcagcgacttacgcctaggtaccagacaaaaccgtgaccagctcccgaggtcctcctcactctagtcggaccnctacgtaccaccgacgggacccacgtcgactacctacccgacgtacccgtaggttcaacgggttcggacgtaggttcggggtacgtacggggaactaacgtaacgttacctaccgttcctaccgacctacgtaccgacggtaccgtacgtaccgtcgtacgtacgttacgttagggtaaacgtttacgttttacgggttaacgtttttaacggtttacgtttacggttacgtaacggttacgttaaagtttaaaccgttaaacgttaaacccgggtttcccgttaacccggtttaacccggtttaaccgttacccggtttttaccggggacccggtttaaaccggggtacccgttaacgggttaaccggttacgggtaaccggtaagtttaaaccccggtaaacgggttaaccgttacggttaacccggggtaccttaccgggtacccttaacccgg

SEQ ID NO: 17180 - DNA, 526 bp, Homo sapiens
  misc_feature: GYAE6OF02FE3B2.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaaggggggaggaactgctcagttaggacccagacggaaccatggaagccccagcgcagcttctcttcctcctgctactctggctcccagagatcattggagaaatgtgatgacgcagtctccagcccaccctgtctgtgtctccaggggaaangccaccctctcctgcagggccagtcagagtgttagcagcgacttagcctggtaccagcaaaaacctgccaggctcccaggctcctcatctatggcgcatccaccacgggcccactgatatcccagccaggttcagtggcagtgggtctgggacagaattcactcctcacctatcagcacgccttagcgtacgtctagtaagtacttttaggtagttttattagtttggtctagtcagttaataattaactggtcctcccgtactacgttttaccggg

SEQ ID NO: 17181 - DNA, 523 bp, Homo sapiens
  misc_feature: GYAE6OF02FV817.53.54.E10.1.454.CMB.1.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
tcagcgcgtatacacacgaccggtgctcgatttagatcgtagcagaacacacaaagggcacgaccggtgctcgattttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagacaaaaacctggccaggctcccagctcctcatctatggcgcactccaccgacgggccactgactacncccagccgaggttcagtcggcaggtggtcgtgggactaggaactcactctacaccatcagcagcctgcagtctagagtagtttcggtagtttatagttgtacagtctaagttataattacgtcggtccctcggttacctacgtttaccgg

SEQ ID NO: 17182 - DNA, 572 bp, Homo sapiens
  misc_feature: GYAE6OF02IVFKS.53.54.E10.1.454.CMB.1.raw
  modified_base (336)..(336): a, c, t, g, unknown or other
  misc_feature (336)..(336): n is a, c, g, or t
  modified_base (407)..(407): a, c, t, g, unknown or other
  misc_feature (407)..(407): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctccgaaggggaagagcccaccctctcctgcgagggccagtcagagtgttagcagcgacttagctggtaccagacaaaaacctggccaggcctcccgacggctcctcatctagtggcgcactccacgacggccacgtgatacnccgacgccgtaggttcgagtggctaggtcgggtcgtacgggacaggtacttcacgtcaccacactacgacncgacgcgtcgcgtagtctagtaagttgtttagtagtttattatgtcagtacgtataagtatacgtcgtaccttcgttacgttacgttcggacgtacgggaccgtaagtcggtaaggacgtaacgtaccgaaacgtacgttcggtacggtcctacgaccgtaaccg

SEQ ID NO: 17183 - DNA, 678 bp, Homo sapiens
  misc_feature: GYAE6OF02GTE10.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatgtgatgacgcagtctccagccacctgtctgtgtctccgaggggaaangcccacctctcctgcagggccagtcagagtgttagcagcgacttagcctggtacagacaaaaccgtggccaggcctcccaggcctcctcatctacgtcggcgcactcccaccgacgggcccacgtacgaactacgtcccacggtcccagggttccaggtacggcgtagggtcgggtcgtacgggacgtaaggtaactttccgaacttccgtaccaacctactacgacgtaccgacgtccctaggcctagttaccgtaggttaaacgttggttttaggtagtttttaattagtttacgttcgtacgtacgtagttaactaaacgtttaacggtcgttaacccttacggttaacgtttaccggttttcgggaccggtaacgggggtaaccgtaacgggtaccggttaagggaacggtaaccgtaacgtaaaaccgggttacgttaacgggtacggtacctacggtacctaacccgg

SEQ ID NO: 17184 - DNA, 616 bp, Homo sapiens
  misc_feature: GYAE6OF02I6B0I.53.54.E10.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatgtgatgacgcagtctccagccaccctgtctgtcgtctccgaggggaancgccaccctctcctgcacggccagtcagtagtgttagcagcgacttagcctggtaccagaccaaaaccgtggaccaggcctccgaggcctcctacatctagtcggacnctactccaccgacgggcccacgtcgactaccgtcccgacgtcccgtacggttaccaaggtcggacctagggtcgggttaccgtacgggaactaggtaacttccgtaacttccgtacctacctagttaccgaacgcctacgtcctggacctacgttacgtagtaacgttagttttaggagttttattacgttgtacctaaggtactaagttacgttaacttacggtaccgttacccttacggtaccttacggtttaccggg

SEQ ID NO: 17185 - DNA, 886 bp, Homo sapiens
  misc_feature: GYAE6OF02H2CXC.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatgtgatgacgcagtctccacgccacctgtctgtgtcctcgaagggaanacgccaccctctccgtgacgacgggccagtccaggagttgttagcctaggcgtacttacgccgtaggtaccgacgaaccaaaaaccgtggacccgtaggccctcccgaacggtcctccccgtactactcttaacgtcggtccgacctaaccgtaccccaacccggaccggggaccctaaccgttaccggtaacttaacccgtaccccgaacgtccccggttaaggtttccgaacgggttcggaccgtacggggttacggttcggtacggggtaccgaaggttaaccttacccggtaaccttccgttaacccgtaaccctacgttaaccgacgtacccgtaacgtcccgttaacgtaccggtaaccgtttacggtaacggtaaacggtttttaacggttttttacgggttaacgttttttaagtttaacggtttacggttacgtaaacggttaccgttaaagttaaacgttttaaaccgttaaacccggttttcccgggttaaacccctttacccggtttaaacccgtttaaccgggttttttacccgggaaccccggggtaacggggttaaccccggtaaacggtaccggttaaggggtaaacccgtaaacgtttaacccgggaaaaccggttacggttaccgggtttaccgggactttaccccggaacccgttaaacccgg

SEQ ID NO: 17186 - DNA, 728 bp, Homo sapiens
  misc_feature: GYAE6OF02I627P.53.54.E10.1.454.CMB.1.raw
  modified_base (206)..(206): a, c, t, g, unknown or other
  misc_feature (206)..(206): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctccagagatcattggagaaatagtgatgacgcagtctccagccaccctgtctgtgtctccgaggggaaancgccacctctcctgcgagggccagtcagagtgtagcagcgtacttacgcctggtacacgaaccaaaaccgtggaccgacggtcctaccgacggtcctcctacgtactctagtcggcacactcccaccgacggacctacgtagtactaccgccacgaccgtacggttacgcggtacggcgtagggtttcgggtacgtacgggaactaacggtacttaccgtactaccgtacctaaccgtactccgtaacgtccgtaccgtcgtacgtacgttacggttacgttaacggttaaacggtttagtttttacgggtttaattttaagtttacgttacggttacgtaacgttaacgtaacgtttaattaaccgttaacggttccgttaccgttaaacccgtttacgttaccggttttagggacccggttaacgggtaccgtaaagggtaccgttaacgggtaaccgtaacgttaaaccgggtaaaccgtacggttaccgggtccggtaacgttaccgacttaacccgg

SEQ ID NO: 17187 - DNA, 569 bp, Homo sapiens
  misc_feature: GYAE6OF02FWUZT.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaanagccaccctctcctgcagggccagtcagagtgttagcagcgacttagcctggtaccagacaaaaacctggccaggcctcccgaggcctcctcatctatcggcgcactccaccgaggccacgtgatactcccagccaggttcagttcgggactaggtcgggtcgtagggacagtaagttccactctacaccatcacgcacgccgtgctagtctagtaagtgttttcggtattttattagtttgttctagactagttaattaatacgtcgaccttacgtaccttacgttttcggaccgtaggggacctaaggtccgttaggacgtaacgtacgtaaacgtacgttaggtacgacgtcgacctaaccg

SEQ ID NO: 17188 - DNA, 684 bp, Homo sapiens
  misc_feature: GYAE6OF02JBFQ6.53.54.E10.1.454.CMB.1.raw
  modified_base (194)..(194): a, c, t, g, unknown or other
  misc_feature (194)..(194): n is a, c, g, or t
  modified_base (250)..(250): a, c, t, g, unknown or other
  misc_feature (250)..(250): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctccagagatcattgganaaatagtagatgacgcagtctccagcccacctgtctgtcgtcgtacgagggaaacncgccacccgttctcctcgacgacggcacgtacgagtaagttcgtaagcgtacgcgtacgttagcctacggtaccacgtaccaaaaacgtcgaccgacggcctacccgagcctccgtacgtatcgtagtcgcgactactccgaaccgtaacggcctactagtactactacccgacgaccgtacggtcgaacgtggacgttagggtcgggttcgtacgggaacgttaaggaactttacgacttaccgtaccgaaccttacgcacgtaccgaccgtcctacggtacgaccgttataacggtaaccggtttagtttaaccggttagtttttaacgttaacgtttcggtaccttaacgtaacgttaacgtttaaacttaacggtaccgttacccgggttaccctttaacccggttacccgttaacgggttttaacccgg

SEQ ID NO: 17189 - DNA, 649 bp, Homo sapiens
  misc_feature: GYAE6OF02HCXN0.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattggagaaatagtgatgacgcagtctccagccaccctgtctgtgtctccgaggggaancgcccaccctctcctgcgacgggccagtcagagtgttagcagcgacttacgccgtggtaccagaccaaaacctcggaccgacggcctacccgaggtcctcctcatctagtcggctcactccaccgaggcccactggactactacccgacgccctaggttccagggtcggacgtagggttcgggtaccgtaggggtaccaaggttaactttccgaaccgttccgtacccgtaacctacgttaccgacgaaccgacgtacccgtaggacccgttacgttacgttacggtaaagtttacgggttttggttaacgttttaagtttagtttcggtaccgtaagtcgtaagtttaactaaggttaaccgttcggtcccttaccggttacgttaccgttttaccggg

SEQ ID NO: 17190 - DNA, 692 bp, Homo sapiens
  misc_feature: GYAE6OF02I2Y7G.53.54.E10.1.454.CMB.1.raw
  modified_base (252)..(252): a, c, t, g, unknown or other
  misc_feature (252)..(252): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagactcattggagaaatagtgatgacgcagtcctccacgccaccctgtctgtcgtcaccgaggggaancgcccaccgtctccgtgcacgggccagtcagagtgtagcagcgacttgccgtggtaccagacaaaaccgtggaccacggtcctcccgaggcctccacctactactacgtcggccgacacgtcccaaccgacgggaccctacgtacgtacgtaccgtcccgtaacgcccgtaacggttaccgtagggtaccggtaccggtagggttcgggttcggttacggggaacgtaacggttaaccgtttactaccgttaccttacccgtaacccgtaactcgaaccgacctacggtaccgtacggaccgttacgtaccgttagtaacgtttacggttttaggttacggttttattttagttacggttacgtacggtacttaagttaacgttaacgttacgttaccggttacccttaaccggtttaccgttaccggttttaaccgggg

SEQ ID NO: 17191 - DNA, 536 bp, Homo sapiens
  misc_feature: GYAE6OF02GXR0J.53.54.E10.1.454.CMB.1.raw
  modified_base (249)..(249): a, c, t, g, unknown or other
  misc_feature (249)..(249): n is a, c, g, or t
  modified_base (463)..(463): a, c, t, g, unknown or other
  misc_feature (463)..(463): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaanagccaccctctcctgcagggccagtcagagtgttagcagcgacttagcctggtaccagcaaaaacctggccaggctcccaggcctcctcatctatggcgcatcccaccgagggcccactgactactcccgagccctacggttcaggtcggctaggtgggtcgtgggacagaattcactcctcaccatcagcacgccctgctagtctagtaagtnttttaggagttttattagtttgtactgtactaagttataattaactggtccctacgttacctacgtttacggg

SEQ ID NO: 17192 - DNA, 646 bp, Homo sapiens
  misc_feature: GYAE6OF02IDCV4.53.54.E10.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (350)..(350): a, c, t, g, unknown or other
  misc_feature (350)..(350): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggcctcccagagatcattgganaaatgtnatgacgcagtctcagccaccctgtctgtgtctcgaggggaaangccacctntcctgcgagggccagtcagngttgtancagcgtacttacgctggtaccagaacaaaaccgtggccaggcctccgacggctcctcactctagcggcacactccaccgcggcctagtgactactccacgcccgtaggtcncggtcgcgtaggtcggtcgtggaacgtagtactactacctacgtacctaaccgtactaccgacgacgtaacgtccgtcgacgtaagtccgtaaggttaacgtttggttttaggttacttttaagttgtcgtaatacggtaacgttaacgtaaattaaacgttaccggtaccgttacccgttaccgttaacgttaccgtttacggacccggtaaacggggtacctacggttccggtaacggacttaaccgtaacgaacggttacgtcgggttaccggaacttcggacctttaaccgg

SEQ ID NO: 17193 - DNA, 705 bp, Homo sapiens
  misc_feature: GYAE6OF02FL8UI.53.54.E10.1.454.CMB.1.raw
  modified_base (366)..(366): a, c, t, g, unknown or other
  misc_feature (366)..(366): n is a, c, g, or t
tcagcgcgtatacacacgaccggtgctcgatttagatcgtagcagaacacacaaagggcacgaccggtgctcgattttagatcgtagcagaacacacaagggggaggaactgctcagttaggacccagacggaaccatggaagccccagcgcagcttctcttcctcctgctactctggctcccagagatcattggagaaatagtgatgacgcagtctccagcccaccctgtctgtcgtctccgaggggaacacgccacctcgtcctgcaggccagtcagtagtgttagcagcgtacttagcctggaccagaaccaaaaccgtcggaccgaggcctacccgaggcctacctctactctagtcggacncgactccgaaccgcggcccacgtgactacgtcccacgtaccgtaggttccacggtacggcgtagggtacgggtcggtacggacgtaagttactactaccgtccgtacccaccgtacttaccgcgtaccgtacggtccgtacgaccgtacgttacgtaaacggttaacggtttagttttaaggggttacgtttttaacggtttaacggttttacgggttaaccgtaacgggtttaacgttaaacggttttaaattaaaaccgggtttaacccggtttacccggggtttacccctttaaacccgggtttaaccgtttacccgggttttttaaacccggggg

SEQ ID NO: 17194 - DNA, 760 bp, Homo sapiens
  misc_feature: GYAE6OF02IPJUK.53.54.E10.1.454.CMB.1.raw
  modified_base (206)..(206): a, c, t, g, unknown or other
  misc_feature (206)..(206): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtcgtctccgaggggaanacgccctacctctcctgacacgggccagtcagagttcgtaagcagcgacttacgccgtggtaccagacaaaaccgtcggaccaggcctaccgacggtctccgtactacttcgtagtcggacgtacacgtaccgaccgacggggaccctacgtacgtaactacgttacccacggtacccgtaacggtttccgacggttacgggtcgtacggtacggggtacggtacggggaactaagggtaactttaccgaccgtttctaacccgtaccgtaacttccgaacggtaccgtaacgtcccgtacgtaccgtaacggttacccttaagggtaaacggtttaggtttttaacgggttaacgtttttacgttttaaggtacgttaaccggtagttacttaagtaacttaaacgtaaccggttcgtacccgttaccggttaacgttaccgtttttacgggacccgttaacgggtacccgtaacggtccggttaacgggagtaaccggtaaccgtaaaccggttacgttaccggtacggtacccgtcggtaccgtaacccgg

SEQ ID NO: 17195 - DNA, 602 bp, Homo sapiens
  misc_feature: GYAE6OF02FWVH5.53.54.E10.1.454.CMB.1.raw
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagcccaccctgtctgtgtctcgagggaagcgcccaccctctcctgcgacgggccagtcagagtgttagcagcgacttagcctggtaccagacaaaaccgtggccgaggcctcccgaggcctccctcatctagtggcgcactcccaccgacgggcccacgtgatactcccagcctaggttcaggtgacgaggttgggtcgtgggacaggtattcactctcaccatcagcacgccgtgaccgtagtctaggaagttcgttttaggttagtttatttagttgtactacgtactagttaacttaatacgttacgtccctaccgttacgttacgtttacggccggtaacgggtaccgtaaggtccgtaaggtaacgtaccgtaaccgtaaaccggtacgttacgggtacggtccttacggaccctaacccgg

SEQ ID NO: 17196 - DNA, 599 bp, Homo sapiens
  misc_feature: GYAE6OF02F2IKA.53.54.E10.1.454.CMB.1.raw
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (450)..(450): a, c, t, g, unknown or other
  misc_feature (450)..(450): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggagaaatgtgatgacgcagtctccagccaccctgtctgtntctccgaggggaaancgcccaccctctcctgcacgggccagtcaggagtaggttagcagcgtacttagccgtggtaccagaccaaaaccgtggccgacggcctcccgaggtcctcctcatctagtcgcgctactccaccgacgggccctacgtacgtactactccccgagcccgtagggttccgtaaggcggtacgtaggtcgggtcgtagggaactaggtacttacaccttacaccactactcgagcacgcctggacngtcgtagtaagttgtttacggtatttattagtttcgctagtactagttaataattactcgtaccttcgtacttacgtttaggaccgacgggtactaaggtcgtaggtactacgtaccgaactacgtcggtacggctacggacttaaccg

SEQ ID NO: 17197 - DNA, 547 bp, Homo sapiens
  misc_feature: GYAE6OF02FFDAY.53.54.E10.1.454.CMB.1.raw
  modified_base (248)..(248): a, c, t, g, unknown or other
  misc_feature (248)..(248): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagacaaaacctggaccaggctcccaggctcctcatctatcggcgcactccaccgacgggcccactgatactcccacgccaggttcaggtcggcaggtcgggtctgggacaggtaattccgactcctacaccatcagccacgcctgactcgtctagaagttagttttaggtagtttattacgtttgtaccagtacgtagtaataacttaacgtccggtaccttaccgtaccttacgtttaccggg

SEQ ID NO: 17198 - DNA, 543 bp, Homo sapiens
  misc_feature: GYAE6OF02F5EKM.53.54.E10.1.454.CMB.1.raw
  modified_base (205)..(205): a, c, t, g, unknown or other
  misc_feature (205)..(205): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaaangccaccctctcctgcagggccagtcagagtgttagcagcgacttagcctggtaccagacaaaaacctggaccaggcctcccgaggcctccctcatctatggcgcatcccaccgacgggcccactgactactcccagcctaggttcaggtcggcgtaggtgggtcgtgggacagaacttcactctacaccatacacgcagcctgctagtctagtaagtgtttaggtatttattattgtctagcgtagtaattaacgtactggtaccttacgtacttacgtttacggcgtacgggacaagcgtaggacgtactacgtaacgacgtacggtgctacgctac

SEQ ID NO: 17199 - DNA, 664 bp, Homo sapiens
  misc_feature: GYAE6OF02H2KJW.53.54.E10.1.454.CMB.1.raw
  modified_base (203)..(203): a, c, t, g, unknown or other
  misc_feature (203)..(203): n is a, c, g, or t
tcagcgcgtatacacacgaccggtgctcgatttagatcgtagcagaacacacaaagggggaggaactgctcagttaggacccagacggaaccatggaagccccagcgcagcttctcttcctctgctactctggctcccagagatcattggagaaatagtgatgacgcagtctccagccacctgtctgtgtctccgaggggaancgccaccctctcctgcagggccagtcagagtgttagcagcgacgttacgccgtggtaaccagaaccaaaaaccgtggaccgaggcctcccacggtcctccctcacttctagtcggccacactcccgaccgacgggaccctactacgactacctcccgacgaccctacgggtttcgaggtcgggcgtaggttcgggtcgtacgggacgtaagtaacttccgtaaccttaccgtaccaacccgtactaccgtacgacccacgtccgtacgtaccgtacggttccttaaggtaacgttagtttttaggttaagtttttaattagtttcgttacgaagtacgtaagttaacttaaacgttacgtacggtcccttaccgttacgttacgtttacggaccggtacgggtaccgaagtaccggtaggagtacgtaacgtaacgacgttaggtcgtacgtcgccgtaac

SEQ ID NO: 17200 - DNA, 715 bp, Homo sapiens
  misc_feature: GYAE6OF02HDD2V.53.54.E10.1.454.CMB.1.raw
  modified_base (204)..(204): a, c, t, g, unknown or other
  misc_feature (204)..(204): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagagatcattggagaaatagtgatgacgcagtctccagccaccctgtctgtgtctccaggggaangccaccctctcctgcagggccagtcaggtagtgttagcagcgacttagcctggtaccagacaaaaccgtggaccaggcctcccgacggcctccgtctatcgtagtcggcgcactccgaccgacgggaccctacgtcgtaactacctcccgacgcccgtaacggttcacggtcggaccgtaggtggggttccgtaggggaactaaggtaaacttacccgacttcccgtacctaacccagttaccgaacgccgaacgtcctcggactaacggttctaggtaaacgtttgttttagggtaagttttttaatttacgttggttacgttacgtaacgttaacgttaaatttaaacgttaccgttacgggtaccctttaaccggttaaccgtttaaccgttttacgggaccgggttaaccgggtaaccgtaacgggtacccggttaagggaactaacggttaaccgtaaaacgggttacgttagggttaccgggaccctttaggaccccttaaccgg

SEQ ID NO: 17201 - DNA, 647 bp, Homo sapiens
  misc_feature: GYAE6OF02IFI49.53.54.E10.1.454.CMB.1.raw
tcagcgcgtatacacacgaccggtgctcgatttagatcgtagcagaacacacaaaggggggaggaactgctcagttaggacccagacggaacaatggaagccccagcgcagcttctcttcctcctgctactctggctcccagagatcattggagaaatagtgatgacgcagtctccagccaccctgtctgtgtctccgaaggggaaagacgcccaccctctcctcgcgacgggccagtcagagtcgttagcagcgacttagctggtaccagacaaaacctcggccagctccgagctcctcatctagtcggcacactacccaccgacgggcctacgtacgatactccgaacgccgtacggttcacgtggacgtaggtcgggtcgtggtaacacggtaacttcacttcctaccacctactccagccactccgtcggtctacgtctaggtaaagtttagttttggttactttttattagttcgttactacggtactaagttaaacttaacgttaaccgtttcggacccgtttacgttaccgttacgtttttcgggaccgtacggggtaaaaccgtacggttaccggtagggtaacgtaacggtaaaccgtaacggtaacggttcggtacggtactcggtaccctaaccgg

SEQ ID NO: 17202 - DNA, 690 bp, Homo sapiens
  misc_feature: GYAE6OF02H1Q34.53.54.E10.1.454.CMB.1.raw
  modified_base (252)..(252): a, c, t, g, unknown or other
  misc_feature (252)..(252): n is a, c, g, or t
tcagcgcgtatacacacgaccggtgctcgatttagatcgtagcagaacacgacaaagggcacgaccggtgctcgatttagatcgtagcagaacacacaagggggagaactgctcagttaggacccagacggaaccatggaagccccagcgcagcttctcttcctcctgccttactcttggcctcccagagatcattggagaaactgtgatgacgcagttctccagccacctgtctgtgtctacgaggggaancgcctaccctctcctgcgtacggccagtcaggcgttgttacgctagcgtacttacgccgtaggtaccacgaccgtaaaaaccgtcggacccacggtccgtacccgacgggtccttcccgtactacttaccgtacgtcggccgtacctacgtacccgaaccgtaccggggcccctaacgttacgaaccttaccgtacccgagttaccgtacggttacgtacgggtcggtacgtagggtccgggtaccggtacggttaagacgttactcgtacgtacctaacgtactacgttacgactacgtaccgtcgtacgtacgttacgcgttaaaggtacgttttaggttacgtttacgttttaagttcgtaagttaccgagttaactaagtttaaccgtacgtacgtacccgttccgttaccgtttaccgttacggttaaccggg

SEQ ID NO: 17203 - DNA, 573 bp, Homo sapiens
  misc_feature: GYAE6OF02GJPRH.53.54.E10.1.454.CMB.1.raw
  modified_base (377)..(377): a, c, t, g, unknown or other
  misc_feature (377)..(377): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaaatagtgatgacgcagtctccagccacctgtctgtgtctccaggggaaagcgccaccctctcctgcagggccagtcagagtgttagcagcgacttacgccttggtaccagacaaaaaccgtgccaggctcccaggcctcctcatctatcggcgcatccaccgacggccactgacttacnccgacgaccctaggttcgagtggacctggtcgggtcgtagggaccaaggtattcactcctcacatcagccacgcctcgctacgttctagtaacgttagttttggtacttttagttaacgttgttactaaggtacgttaagttaagttaacgttaacgttccggtaccctttaccggttaccttagttttacccggg

SEQ ID NO: 17204 - DNA, 702 bp, Homo sapiens
  misc_feature: GYAE6OF02FNPYH.53.54.E10.1.454.CMB.1.raw
  modified_base (194)..(194): a, c, t, g, unknown or other
  misc_feature (194)..(194): n is a, c, g, or t
  modified_base (331)..(331): a, c, t, g, unknown or other
  misc_feature (331)..(331): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagcgcgtatacacacgaccggtgctcgatttagatcgtagcagaacacacaaagggggaggaactgctcagttaggacccagacggaaccatggaagcccccagcgcagcttctcttcctcctgctactctggctcccagagatcattggagaaatagtgatgacgcagtctccagcccaccctgtctcgtntcctccgaggggaaagcgcccacccttctcctgccgacgggccagtcaggtagttgttaacgcagaccgtacttacgccgtacggtaccagaaccaaaaaccgtcggaccgacggcctacccgaggcccgtcctacntactagtcggcgacctacgtcccaccgacgggcctacgtacgacttacncccngtaccgtacgtacgtaggtcggacgtggttagggtcggtacgggaacaggtaacttccgtactccgtacctaccacgtaccgacgacgaccgtccgtacgtaccgacggttactaggttaaggtttacgtttttagggttacttttaagtttacgttagtaccgtagacttagtaaacttacttaaccggtacgtcccgttaccgttagttaccggtttccggaccggtaacgggtaccgtaacggtcggttaacggaacgtaacgttaaccgtaaaccggtacggtaccggttacggtacccgtagtaccctacccg

SEQ ID NO: 17205 - DNA, 614 bp, Homo sapiens
  misc_feature: GYAE6OF02FOFBB.53.54.E10.1.454.CMB.1.raw
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtntctccgaaggggaaancgccaccctctcctgcagggccagtcagagtgttagcagcgtacttagcctggtaccagacaaaaaccgtggaccaggcctcccgaggcctcctcatctatcgcgcactccaccgacggccactcgactactccacgccgaggttcaggtcggcgtacgggtcgggtcgtacgggactaggtaacttcgtactccgtaccacctacttaccgacgactacggtccctggaccgtacgttccgttaggtaaggttacgtttttagggttagttttaagttttacggttagttaccgtagtacgtaagtttaattaacgttaacgtacggttacccgttaccgttaccttaccggttttaaccggg

SEQ ID NO: 17206 - DNA, 673 bp, Homo sapiens
  misc_feature: GYAE6OF02FVT3P.53.54.E10.1.454.CMB.1.raw
  modified_base (249)..(249): a, c, t, g, unknown or other
  misc_feature (249)..(249): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggcctcccagagatcattggagaaatagtgatgacgcagtctccagccaccctgtctgtgtctccgaaggggaangccacctctcctgcagggccagtcagagtgttagcagcgacttagcctggtaccagacaaaaacctggccaggctcccgaggctccgtcactctatcggcgcgactccaccgagggtcccacgtgactactccccagacccgtaggtttccaaggttcggaccgtaggtacggggttccgtaggggaacctaaggttaactttaccaccgttcctaccgtaaccctaacttaccgaacgaccgtaacggtcccttacggacgtaccgttaccgttaggtaaaccgtttagttttttcggggtaacgtttttaagttttacgtttaacggtccgttaaggtaccgttaaacggtttatttaaacgttaaccggttaccggtacccgtttaccccggtttaacgttacccgttttttaacccgggg

SEQ ID NO: 17207 - DNA, 597 bp, Homo sapiens
  misc_feature: GYAE6OF02FK8VF.53.54.E10.1.454.CMB.1.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
tcagcgcgtatacacacgaccggtgctcgatttagatcgtagcagaacacacaaaagggggagaactgctcagttaggacccagacggaaccatggaagccccagcggcagcttctcttcctcctgctactctggctcccacgagatcattggagaaatagtgatgacgcagtctccagccaccctgtctgtgtctcgaggggaaangccaccctctcctgcacgggccagtcagtagtgttagcgagcgacttagcctggtaccagacaaaacctggccaggctccaggctccncatctatcggcgacactccaccgacgggccactcgatactcccacgcctaggttcaggtcggctacggtgggtcgtagggacagtactcaactcctacgaccatcacgcgacgtcgtcggctacggtctaggtaacgttagttttacggtatttagttattcgtactagtactaggtacttaaacgtacgttagtcccttacgttacgttacgtttacggaccgtacgggtaaccgtacggtacgtaggtaacgaacgttaacggtaaacgtacgttcggtacggtacgtacgtactaaccg

SEQ ID NO: 17208 - DNA, 653 bp, Homo sapiens
  misc_feature: GYAE6OF02HMRV1.53.54.E10.1.454.CMB.1.raw
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattcggagtaaatagtgatgacgcagtctccagccaccctgtccngtcgtctcgaggggaaangccacccgtctcctgcgtacggccagtcgagagtgttagcagcgacttacgccgtggtaccagacaaaaccgtggaccagcctcccgagcctccgtacactctatcggcacgactaccgaccgaacggcctaacgtgtaactaccgtaccgacgtacccgtacggttacgaacggttcggacgtaagggttcggggtaccggttagggaacccaagggttaactttaccgacgtttccacgtaaccaacttcgacgaccacgcctaggacctacgttaccgtacgtaaagtttacgttttagttaagttttatttacggttacggttctaaggtccttaaaggttaacttaacgttaaccgtccggttaacccttacgttacctttacggtttacccggg

SEQ ID NO: 17209 - DNA, 650 bp, Homo sapiens
  misc_feature: GYAE6OF02GTVX2.53.54.E10.1.454.CMB.1.raw
  modified_base (252)..(252): a, c, t, g, unknown or other
  misc_feature (252)..(252): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagacgatcattggagaaaatagtgatgacgcagtctccagccaccctgtctgtcgtctccgaggggaaangccaccctctctgcagggccagtcagagtgttagcagcgactagcctggtaccagacaaaactggaccaggctcccagctcctcgatctatcggacgcaactccaaccgacggccaactgataactcccagccctaagggttccaggttcggacgaggttagggtccgtcggggtaaccaggtaaattcgaccttctacgtacccaactcgaacggtaccacggccttacggacctaacgttaccgtaagtaaacgtaagtttttcgggaagttttttaattaacggtttcggttaccgtaaaggttaccgtaaacggttttaattaaaaccggtttaaaccgttcgggtaaccccccgttttacggttaacccgtttacccgtttttaacccggggg

SEQ ID NO: 17210 - DNA, 701 bp, Homo sapiens
  misc_feature: GYAE6OF02IIZBT.53.54.E10.1.454.CMB.1.raw
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctcccagagatcattgganaaaattagtgatgacgcagtcctccagcccacctgtctgtntctacgagggaaactgccaccgtctcctgcgacggccatacagagtgtacgnagcgtactagtcctcgtacacgacaaaactgaccagccnccgacgctactcatactgtgcgactacnccacgaccggcaactcgtaactacacccgtacgaccgtaacggtacgtaacggtcggacgtaacgggttcggggttaccggtacggggtaacctaaacgggttaaacttttacccgaccgtttacctacccgaaaccctaccgttaacgacggtaaccgtacggtaccctacgtaaccgttacggttacccgtaaggtaaacggttttacgggtttttaaggttaacgtttttaattttaccgttaacggtttacccgaaggttaaccgtaaagttaaacttaacgttaaaccgggtacccgttaacccgtttaacccggtttaccgttacggtttttacccgggg

SEQ ID NO: 17211 - DNA, 1003 bp, Homo sapiens
  misc_feature: GYAE6OF02H8LJY.53.54.E10.1.454.CMB.1.raw
  modified_base (170)..(170): a, c, t, g, unknown or other
  misc_feature (170)..(170): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggcctcccagagatcattggaagaaatagtgatgacncagtctccagcccaccctgtctgtgtcctcgaaggggaagcgacccaccctctccgtgcgacgggcctagtcaggtagtggttagcgaggccgtacgttacgccgttacggtaaccaagaaccaaaaaccgtcgggaccgacgggtaccctacccgaacggtcccttcccctacgtacctttaccgtaaggtcgggccgtacctaaccgttccccgaaacccgggaccggggtacccctaaccgttacgggtaaccttaacccgtaacccccgtaaccgggtaccccgttaacggggtttaccgaacggggttacggggacccggttaacgggggttccggggggtttaccggttaacgggggaaacccgttaaacgggttaaacccgtttacccgttaaccccgtttacccgttaacccgaaaccccgttaacgttacccgggtaaaccggtacccgtaacccgggttaccgttacccgggacccgtttaaacgggtttaccggttaaacggttaaaacgggttttttcgggtttttttaaacggggggtttaaattttttttttaaaccgggtttaaggttttaacccgggttagtttaaaaccgggtttaaccgttaaagttttaaaaccgtttaaaacggtttaacccggtttaccggggtttaaaccccttaaccgggtttaaaccgttttccggttttaccgggggaaccccggttaaacggggggttaccctaaacgggttccgggttaacggggaactttaaacccggtaacggaaaacccggttggttaccgggtaccggtcgtttaacccgacggttaacccg

SEQ ID NO: 17212 - DNA, 966 bp, Homo sapiens
  misc_feature: GYAE6OF02JWU7L.53.54.E10.1.454.CMB.1.raw
  modified_base (163)..(163): a, c, t, g, unknown or other
  misc_feature (163)..(163): n is a, c, g, or t
  modified_base (240)..(240): a, c, t, g, unknown or other
  misc_feature (240)..(240): n is a, c, g, or t
tcagcgcgtatacacacgaccggtgctcgatttagatcgtagcagaacacacaaagggcacgaccggtgctcgatttagatcgtagcagaacacacaaggggagaactgctcagttaggacccagacggaaccatggaacgccccagcgcagcttctcttccnctgctactctggacctcccagacgatccatttgggaactaaataggtgacttagaccgactaaggtcctaccgaacnccccgtaaccgttcggttacctggttcgtacccgtaccggaacggggggaaaatccggacccctaccccgttaccgtcccgttaggacccggaaccggggtacccgtaacggtacccgtaacgggtacgttccggtttaacgccgaacggtaccggtaacccgtttacggtaccccggttacgggtttaacccggaaccgtaaacccgttaaaaaaccccggttaccgggacccgaaccgggtccccgttacccggaaccgggtaccttccccgtacctaacgttaccgttaacggtccgggtaccgttacccgtaaccgtacccggtaaaccccgtaccgggggtacccctaaccggttacccggtaaccgttaacccgttaaccccgccggggttaaaccctaccggggtttaaccgtaacgggttacccgggaacgttcggggtttaaccggggtaccggttaccggggtaaaccgaaacggtttaacgttacccggttaaaccctccgtttaacccgacccgttaaccgtacccgtaaccggtaccgtaaccgttacccgtacggtaacccgttaacggtaccgttaacgtaaacgttccgttttaaggttacgtttaacgtttaacggtttcgaaccgtttcgtaaaccgttacggttaacgttaaaccgtttcgggtaccgtttacccggtttacccgtttaagttcccggtttaacggg

SEQ ID NO: 17213 - DNA, 788 bp, Homo sapiens
  misc_feature: GYAE6OF02J17LJ.53.54.E10.1.454.CMB.1.raw
  modified_base (203)..(203): a, c, t, g, unknown or other
  misc_feature (203)..(203): n is a, c, g, or t
tcagcgcgtatacacacgaccggtgctcgatttagatcgtagcagaacgacacaaagggggaggaactgctcagttaggacccagacggaaccatggaagcccagcgcagcttctcttcctcctgctactctggctcccagagatcattggagaaatagtgatgacgcagtctccagccacctgtctgtcgtctcgagggaanacgccacctctcctgcagggccagtcagagtgttagctagcgtacttacgccgtacggtaccagaccaaaaccgtcggaccgacggccgtacccgacggccttccgtactactactagtcggaccgtcaccgtccgaccgagggtacccacgtacggtactacgtacccgacgcccgtaaggttccgtaaggtcggacgtacggttcgggtacgtacgggaacgtaacgttaaccttacgtaccgttaccgttaccgaccgtaaccgttcgaacccgacgtaaccgtccgttaggtaccgtaacgttcgtaacggttaagtttacggttttacggtttaaatttttacgttagtttacggtacgtaacggttaccgtaaagtttaaccgtttaaacgtacggttttaacccgtccgtttaaacccggttaacgtttttaccgggtttaccggggttaccggtaaccgggttaacccgtaacgggtttacccggtaagggttaaccggttaaccgttaaaccgggttaaccgtttaaccgggttacgggttacccgtaccggtttaccggaacccgtttaaccccg

SEQ ID NO: 17214 - DNA, 853 bp, Homo sapiens
  misc_feature: GYAE6OF02FHVFP.53.54.E10.1.454.CMB.1.raw
  modified_base (159)..(159): a, c, t, g, unknown or other
  misc_feature (159)..(159): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatcggaagccccagcgcagcttcncttctcctgctactctggctcccagagatcattcggagaaatgtgatgacgcacgtctccagccctaccctgtcctgttcgtctcccgaagggggtaaacncgcccaccctcctccgtacgcacgggtccacgtcgaggagtcggttacncgtacgccgtacgttacgtccgttaggtaccacgtaccgtaaaaacccgtcggacccgtaacggaccttacccccgaagggcccttacccgtccgtaacgttcccgttaacgtcgggtaccggacctaaccgtaccccgaacccgtaaccggggaccctaaccgttacgtaaccgttaaccttaccccgaacggttaccccgtaagggttttacccgtaacgggttaccgggtacccgtaacggggtttccgggggttaccggttaacggggtaaacccgtaacgggttaaacctttacccgtaacccgtttacccgttaacccgaacccgtaaccgttaaccgaaccgggtaccgtaaccgggtacccttaccgggtaacctaaccgggttacctaacgggttaaaccgtttacgtttttaacgggttacgtttttaacggtttaacgtttacggtaacgtacggtaacgtaacgtttaaacgtaaccgtttaacgttaccgggtacccctttcccggttaacgttacccggttttaaccggg

SEQ ID NO: 17215 - DNA, 714 bp, Homo sapiens
  misc_feature: GYAE6OF02JPYM2.53.54.E10.1.454.CMB.1.raw
tcagcgcgtatacacacgaccggtgctcgatttagatcgtagcagaacacacaaagggcacgaccggtgctcgatttagatcgtagcagaacacacaagggggagaactgctcagttaggacccagacggaaccagtggaagccccagcgcagcttctcttcctcctgctactctggctcccagagatcattggagtaaatgtgatcgacgctagtcctccgagccctacctgtcttgtacgtcctaccggaaggggaaactcggccctacccgttctccgacggaccgtacgggccgtagtacgtacggtaagtcggttaacgcgacggtacgtacgttaccgaccgtcggtaaccaagaaccgtaaaaccgtcggaccgacggtcctacccggacgtcctccctacgacttaccgtagtccggactacgaccgtacgtaacccggtacggaaccctaccgtacgtacgttaaccctccggtaaccgccgtaacgggttacgacggttcgaccggtagggttcgggtacgtaggacctaaggtacttaccgacgtacctaccgtcctaagtccctaagcccgtagccgtcgtaacgtcgtaagttacggtaacttagtttgttactttaagttcgttacggtacgaacgtaaccgtttaagtaacttccgtaacgtaccggttacccttaccggttaattcccgttaaccggg

SEQ ID NO: 17216 - DNA, 724 bp, Homo sapiens
  misc_feature: GYAE6OF02GA72X.53.54.E10.1.454.CMB.1.raw
  modified_base (183)..(183): a, c, t, g, unknown or other
  misc_feature (183)..(183): n is a, c, g, or t
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
tcagcgcgtatacacacgaccggtgctcgatttagatcgtagcagaacacacaaagggcacgaccggtgctcgatttagatcgtagcagaaccacacaaggggagaactgctcagttaggacccagacggaaccatggaagccccagcgcagcttctcttcctcctgctactctggctccagngatcattggacgtaaatgtgatcggacncagtctccagcccaccttgtctgtgtctaccgaggggaaacncgccacctctcctggcgaacgggccacgtaccgaggtacgttcgttagccaggacgtaccgttacgccgttacgggtaacctaacgtaaccgaaaaaccgtcgggaccgtaacgggaccttacccggaacggtccttccgtacctaacgttcctaacggtcggggacctacgtaacggtacccaaccgggacgggtaccctaaccgtcgtaacgttaaccctacccggaacgtacccgtaacgggttttccaacgggttcgacggtagggttcgggttacgtacgggtactaacgggttaacttcgtaaccgttcgtacgacccttagtaccgtacggaccttacgccttaggccgtagtacctaggtacttaggtttacgttagttttaaacgtgttttacgacgttagtaccgtaagttaactaacgttaaccgtggtaccctttaccggttacgtacgttttaccggg

SEQ ID NO: 17217 - DNA, 707 bp, Homo sapiens
  misc_feature: GYAE6OF02H7534.53.54.E10.1.454.CMB.1.raw
tcagcgcgtatacacacgaccggtgctcgatttagatcgtagcagaacacacaaaagggggaggaactgctcagttaggacccagacggaaccatggaagccccagcgcagcttctcttcctcctgctactctggctcccagggatcattggagaaatagtgatgacgcagtctcagccaccctgtctgtgtcctccgaaggggaaacgcgccaccctcctcctgcgacgggccagtcagagtgtacgcagcgacttacgccgtcggtaccagactaaaaaccgtggaccacggcctacccgacggtcctcctcctactctagtcggcgtccactcccgaaccgacgggccaacgtgtactacctccgacgccgtacggttcgtaggtcggtacgtacggtcgggtacgtacgggaactaaggtacttccgacgttcctaccacctagtacctacgcctacggccctgaccttacggtcgtacggtaacgttaggttttttaggtaacgtttttaatttagtttcgtaacgtacggttacgtaaagtttaacttaaacgttaccggtacggttaccccgttaccgttaaacgttaccgttttacggacccgggtacgggtaaacccgtaggtccggtaaggacgtaaccgtaaaccgtaaacggtacgttacgggtaccgtaccggtacgtaccccgtattacccgg

SEQ ID NO: 17218 - DNA, 849 bp, Homo sapiens
  misc_feature: GYAE6OF02IVXPN.53.54.E10.1.454.CMB.1.raw
  modified_base (142)..(142): a, c, t, g, unknown or other
  misc_feature (142)..(142): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
tcagcgcgtatacacacgaccggtgctcgatttagatcgtagcagaacacacaaagggggaggaactgctcagttaggacccagacggaaccatggaagccccagcgcagcttctcttcctcctgctactctggctcccagngatcattggagaaatagtgatgacgcagtctccagccacctgctgngtctcgagggaancgccacctctctgcagggccagtcagagtgtagcagcgtactacgctcggtaccagacctaaaacgtcggaccgtacggcctacccgagggtccctacctacgtaacgtccgtacgtaccgggcaccgtactacccgaccgtacggggtaccctaccgtgaaccgttaccgtacccgtaacggccgtacgggttaccacggttacggaccgtacgggttaccgggtacgtggggaaacctaacggtaacgttaccgtaaccttcccgtaacctaacccgtagacccgtaggaacctacggaccgttcgtaaccgtacgtccgtaaagtaacgggtttagttttacggggtaacgtttttaacgtttaacgtttaccggttaacgtaccgttaacgggtttaacgttaaacgtttttaaaccggtaaaccgtttaacccgggttaccccgtttaaaccggttaaccgttttaaacccggggtttttacgggtaacccccgggttaaacggggggttaaccgtaaacccggtttacgggttaaaacgggtaacccgggttaaacccgtttaaaacggtaaaaccccgggttaacgttaaccggggggttaacgttaccccgggttaaccggtacccgttaaaaccccggg

SEQ ID NO: 17219 - DNA, 608 bp, Homo sapiens
  misc_feature: GYAE6OF02FSJ0Z.53.54.E10.1.454.CMB.1.raw
  modified_base (197)..(197): a, c, t, g, unknown or other
  misc_feature (197)..(197): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagcccccagcgcagcttctcttcctcctgctactctggctcccagagatcattgganaaatagtgatgacgcagtctccagcccaccctgtctgtgtctccgaaggggaaagcgcccaccctcctcctgcagggccagtcagagtgttagcgagcgtacttagcctagaccagacaaaaccgtggccgaggcctaccgaggtcctcctcgtactcgtatcggcncactccaccgacggccctactacgactacncccgagccgtacggttccaggtcggctaggtcgggtacgtagggactagtaacttcgactacctctacctacttcgaacgcgtcgtacccgtgacgtacgtcgtacggtaaagttacggttttaggttacgttttaagtttacgtttcgacttacggtctaaagttaacgtaacgttaacgtcggtacccttacgtacgtttaccgttaccggg

SEQ ID NO: 17220 - DNA, 702 bp, Homo sapiens
  misc_feature: GYAE6OF02JRMKU.53.54.E10.1.454.CMB.1.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagatcattggagaatagtgatgacgcagtctccagccacctgtctgtntctacgagggaancgccacctctcctgacgtacggcctagtcacgtaggtgttagcaggcgtacttacgccgtaggtaccagaaccaaaaccgtgggaccaggtccctaccgaggtcctaccgcacttacgtagtcggccgacacgtcccgacggtacggccacgttacgactactacccgacgcctacggttcacgggtcgcgtaggtcgggtaccgtagggactaaggtacctttaccacgttccctacgaaccctacgttacaccgggtacccgtacgtacccgtacggtaaccgtaccggtttacgtaaacggttaaggttttacggttttacgggttactttttaagtttaaccggttcgttaaggttaaccggtacgtttaaacggtttactttaaaacggttaccggtaacccgggtttcccttaaaccgggttttaccgttacccggtttttaaccggggg

SEQ ID NO: 17221 - DNA, 832 bp, Homo sapiens
  misc_feature: GYAE6OF02GIWQY.53.54.E10.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
tcagcgcgtatacacacgaccggtgctcgatttagatcgtagcagaacacacaaagggggagaactgctcagttaggacccagacggaaccatggaagccccagcgcagcttctcttcctcctgctactctggctcccagagatcattggaagaaatgtgatgacgcagtctccagcccacctgtctgtgtctccgagggaaancgccacctntcctgcgacgggccagtcaggtatgttacncagcgacgttagcctggtaccagacaaaaccgtcggaccaggcctcccgaggtcctaccctcactctagtcggacgactacctaccgaacccgacgggacctaccgtagtacttaaccgtaccccgaacgtacccggtaacgttacgtacggtcgggaccgttacgggttacggggttcgtacgggggtaaactaacggttaaacgtttacccggaacctttcccttaaacccgacccgtaacgtaccgtaacggtccctaacggtacccgttcggaaccgttacgggttaccgtaaggttaaacggttttaggttttaaccggggttaattttttaaacgttttacggtttaacgggtttaccgtaaacggttaacgttaacggtttaaacttaaaccggtttaacgtccggtttaccccggtttacccgtttaaacgtttaacccggtttccgggaaccgggttaaaccgggacccgtttaaacggaccgggtttaagggtaaccccggttaaaggttaaacccgggaaaacccgtttacggttaccggggtaacccggttacggtacccggtaacccttaacccgg

SEQ ID NO: 17222 - DNA, 682 bp, Homo sapiens
  misc_feature: GYAE6OF02H7PBG.53.54.E10.1.454.CMB.1.raw
  modified_base (140)..(140): a, c, t, g, unknown or other
  misc_feature (140)..(140): n is a, c, g, or t
  modified_base (161)..(161): a, c, t, g, unknown or other
  misc_feature (161)..(161): n is a, c, g, or t
  modified_base (265)..(265): a, c, t, g, unknown or other
  misc_feature (265)..(265): n is a, c, g, or t
tcagcgcgtatacacacgaccggtgctcgatttagatcgtagcagaacacacaaagggcacgaccggtgctcgatttagatcgtagcagaacacacgaagggggagaactgctcagtaggaccagacggaacatggaacncccagcgcagcttctcttccnctgctactctggcctccagagactcagttggaataaatgtcgagtacgacgcacgtctaccacgcctaccgtgtccgtgttcggtacctacggaaggggtaaancccgtccgtaccctccgtaccgtcgacgtacggaccacggtacgtacgtaggttacgttacgcgaacgtcgtacgtacgccgtacgtaccacgaacgtaaaaccgtcgacgcgaccgtccgacggtcctacctaccgtatacgtcgacgccgtactaccgtaccgtaccggacgactacgtacgtactaccgtaccgtacgccgtacggttacggacgtcggtacgtacgggtcggttaccgtggtaacgacgttaacgttccactaccgcaccgtacgacgacgtccgaccgtcacgtacgtacgtcgtaggtaagtttaggttacgttacgtttacgtttacgttcgtacgtacggtaacttaagttaacgtacgtacggttaacgtcccggttacttaccggtacgttacccgg

SEQ ID NO: 17223 - DNA, 746 bp, Homo sapiens
  misc_feature: GYAE6OF02JY05Q.53.54.E10.1.454.CMB.1.raw
  modified_base (161)..(161): a, c, t, g, unknown or other
  misc_feature (161)..(161): n is a, c, g, or t
  modified_base (271)..(271): a, c, t, g, unknown or other
  misc_feature (271)..(271): n is a, c, g, or t
  modified_base (639)..(639): a, c, t, g, unknown or other
  misc_feature (639)..(639): n is a, c, g, or t
  modified_base (656)..(656): a, c, t, g, unknown or other
  misc_feature (656)..(656): n is a, c, g, or t
tcagcgcgtatacacacgaccggtgctcgatttagatcgtagcagaacacacaaaggcacgaccgtgctcgattagatcgtagcagaacacacaagggggagaactgctcagttacggacccagacggaccatggaacgccccagcgcagcttctcttccncctgctactcgtggcctcccagacgtatcattggaagtaaatggtagactgaacgcaacgtctccacggccaacccgtgtcctaggttgtcccttaccggaaggggaaanaccggccctaaccgttcctacccgtggaccgacgggtaccacggttaccgaaggaacggttcgtttaaacggtccgtaacgggaccgtaaacggttttcgacccgtacggggtttaacccaaacggaacccggtaaaaaacccgttccgggaaccgtaacggggtaccccttaaccccgtccgggaaccttcccgtaactaccgtacgtttacgaccgggtacacctaccgtacccacgtaccggggtcccaacgtacggtactaacccgtccgaacggcgtaaaccggttcgtacggacggtacgtcgggttaacggggtccgtaaggaccgtaaggtaacttacgtacctctacgactcacgtacnctacgtcacgcgtacgntagtaattaggtacgtttattcgttacgtgtacacgtctaaagttctaaagtccgtacggttccttacggtacccgttagttaacccggg

SEQ ID NO: 17224 - DNA, 747 bp, Homo sapiens
  misc_feature: GYAE6OF02JXDHI.53.54.E10.1.454.CMB.1.raw
  modified_base (286)..(286): a, c, t, g, unknown or other
  misc_feature (286)..(286): n is a, c, g, or t
  modified_base (595)..(595): a, c, t, g, unknown or other
  misc_feature (595)..(595): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggcctcccagagactcattggagaaatgtgatgacgcagtcctccacgccctaccctggttcctggttcgtccgtaccggaaggggtaaagaccgaccgtaccctcctccncgtcgcgggccgacgtcaagagtggttaacgcgaggtaccgaccgtttacggcccgtacgggtaaccctaacgacccgaaaaacccgtcgggaccctaacgggcccttccccgaacggtcccttaccgtacgacttacgtaagtccggacgtccctaacgtccccaaccggacggtcccacgtaccgacgtaccctacccgtaacggacccgtaccggttccgtaaacgggtccgggacgtacggggttcgggttaaccgggtcgggtaacgaacggttaacgttcctaccgtcctaccgacctaaccncggttaccaccggtaccgtaccgtggtacccgttgtaaccgtaagtaacgttacgtttagttacgttttagttaccgttgtacgttacgtataacggttaagttaacgtacgtaccggttacccgttaacgttaccgttaggttaacccggg

SEQ ID NO: 17225 - DNA, 664 bp, Homo sapiens
  misc_feature: GYAE6OF02H3ENZ.53.54.E10.1.454.CMB.1.raw
  modified_base (185)..(185): a, c, t, g, unknown or other
  misc_feature (185)..(185): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (542)..(542): a, c, t, g, unknown or other
  misc_feature (542)..(542): n is a, c, g, or t
tcagcgcgtatacacacgaccggtgctcgatttagatcgtagcagaacacacaaagggcacgaccggtgctcgatttagatcgtagcagaacacacgaagggggagaactgctcagttaggacccagacggaaccatggaacgcccagcgcagcttctcttcctcctgctactctggctcccagngatcatggaagaaatagtgatgacgctagtcaccagccaccttgtcctgtacgtctacggaaggggaaaancgacctaccctctccngacgacggcagtcaggtagtcgtagacgacgcgtacgtaacgctacggtaccaacgaacctaaaaaccgcgggtacacggtacctacccgtacgggacccttaccgtacctacgttacgttaagcggtacacgtaccgtaccgaacccggaacggacctacgtacgaactacccgtaccgacgaccgtacggtaccgtaggtcggtacgtaaggtcgggttacgacgggaacaacggtaactttaccgacgttccgtaaccactaaaccncgtaacgccgtacgaccgtcgaccgtaagtcgtaaggacgttacgtttagtacgtttagttagtcgttaaccgagtactaagtacttaacgacgttaccgtcctacgtaccgttagtaccgg

SEQ ID NO: 17226 - DNA, 812 bp, Homo sapiens
  misc_feature: GYAE6OF02INYE8.53.54.E10.1.454.CMB.1.raw
  modified_base (155)..(155): a, c, t, g, unknown or other
  misc_feature (155)..(155): n is a, c, g, or t
tcagcgcgtatacacacgaccggtgctcgatttagatcgtagcagaacacacaaaggggggaggaactgctcagttaggacccagacggaaccatggaagccccagcgcagcttctcttcctcctgctactctggctcccagagatcattggaanaaatagtgatgacgctagtcctaccagcccaccctgtctgtcgtcctccggaaggggaaagcgcccacccttctcctgaccgagggccagtcaggtacggttgttagcagcgtacttagcctgtacagaacaaaaccgtgaccgacggcctcccgaggccctcctcactcgtagtcggcactacctaccgaccgacgggacctacgtacgtaactaccgtccgacgaccgtaagttcgaggttacgcgtagggtcgggtacgcggggaactaacggtacttaccgtacctaccgtaccctaaccgtaacgtaccggaccggtacccggtaaccggtcccgttaacgggtacccgtaccggtttaaccgggtaaaggttaaaccggttttaaggtttttcgggggttaaaaccttttttaggtttaacggtttccggttaaacgtaccgggttaattaaacggtttaaacttaaacccgtttacggttaccgggttaccccgttaacggtttaaccgtttaccgggtttaccggggacccgggttaaacccgggtaacccgtaaacggtcccggtttaagggtaaccgttaaccgtaaacccgggtaaccgttaaccggtaccgggttaccggtaccgtaccggtacccttaacccgg

SEQ ID NO: 17227 - DNA, 890 bp, Homo sapiens
  misc_feature: GYAE6OF02GY41J.53.54.E10.1.454.CMB.1.raw
tcagcgcgtatacacacgaccggtgctcgatttagatcgtagcagaacacacaaagggcacgaccggtgctcgatttagatcgtagcagaacacacaaggggggaggaactgctcagttaggacccagacggaaccatggaacgccccagcgcagccttctcttcctcctgcctactctcggcctacccagagatctagttggaagtaaagttaggtagatacggaccgtcgtacgtcctacccgacgtcccctacccgttgtccttggtcgtccgtaccggaagggggaaacgtccgacccctaccccttccgtccgtcgaccggaaccgggaccctacggtacgaaggttacgggttcggttaacggaccggtacggacccggttaactttaccgggtacccgtacgggttaacccggaaacggtaaaacccgtaaaaacccggttccgggaccccggtaaccgggtacccccgttaccccggacgggttaccccttaccccgttaaccgtaaccgtttacccggtttaaggtcccggggtacctaaccccgttaacctaaccccgggaacccggggtaaccggaccctaacggtacggtaaccctacccggtacccgtaccggtacggtaccggtttacggacggtacggtacggtacgggttcgggtacggtacgggtactaaacggttacttaccgtacctcctaccgactcgcgacgacgtacgtcgtacgcgttagttacctaggttaacgtttcggttttaagttacgttttaacgtttcggttacgtaacgttaacgttaacgttaaacgtttaagtttaacccggttaccggttaacccggttacccgtttaaccggttaccggtttccggttaaccggg

SEQ ID NO: 17228 - DNA, 1183 bp, Homo sapiens
  misc_feature: GYAE6OF02JKVH6.53.54.E10.1.454.CMB.1.raw
  modified_base (209)..(209): a, c, t, g, unknown or other
  misc_feature (209)..(209): n is a, c, g, or t
tcagcgcgtatacacacgaccggtgctcgatttagatcgtagcagaacacacaaagggcacgaccggtgctcgatttagatcgtagcagaacacacgaaggggggaggaactgctcagttacggacccaggaccggaaaccagtaggaacgcccccaggccgccagtccttcctctttccctcctcgcctactctcggcctcccagganactacgagttagggaataaaataggtcggatcggaccggtactacgttcctaccgtacgcccctaccctggttcctcgggttcgtcccttaaccggggaaacgggggaaacgtccgtcccccttaacccgttccctaccccgtcgaccggaaccggggtacccgtaacggttacccgaagggttacggttaccgggtaacggtaccgtaaccgggtaccggttaaccgttaccgggtcccggttaaccgggttaaacccgaaaccggtaaaaccccgggttaaaaaacccgccggggtaccccggtaaccggttccccggtacccccgggttaccggtacccccggtttacccctttaaccggacctttaaccccggttaagggttcccggtaaccggttaccccctaaacccggttacccccggaaaaccccggggtaccccgggttaacccgtaaacccgttacccggttaaaaccccgtttaccccgtaaccccccgggtttaaccggttaacccccggtttaaacggggtttaacccgttaccgggggtaacccgggttaaaccgggttcgggggtttaacccggggttcgggtaacccggggggtttaaaccggttaaacggttaaccccgtttaacccgttaacccgttaacccgtacccctaaaaccggtacccgtaccggttaaaccgggtccccgttacccgtttaacccgaaccgggtttccccgtaaacgggttttacccgggtaaattttaaacccggggttttaagggttttaaacggggtttttttaacccggttttaacgggttttttaaccgggttaccccggttaaaaggtttcgggttaaaaaccgtttaacccggttttaaaggttaaaaccccgttttacggggtttaaacccccgtttaacccgggttttaaacccccgtttaaccggttttacccgggttttaacccggggg

SEQ ID NO: 17229 - DNA, 891 bp, Homo sapiens
  misc_feature: GYAE6OF02GXRGE.53.54.E10.1.454.CMB.1.raw
  modified_base (211)..(211): a, c, t, g, unknown or other
  misc_feature (211)..(211): n is a, c, g, or t
tcagcgcgtatacacacgaccggtgctcgatttagatcgtagcagaacacacaaaggggggaggaactgctcagttagggacccagacggaaccatgggaagccccagcgcagcttctcttcctcctgctactctggcctcccagagatcattggagaaataggtgatgacgcagtcctcagcccacctgtctgtgtctccgaaggggaanacgccctacccttctcctggcgacgggccagtcagtaggtcgttagcacggctacttacgcccgttagggtaacccaggaacctaaaaaccgtcggaccccgaacgggcctacccccgagggtcctccctacgacttctaacggttcgggccgacctaccttacccgaacccggaccggggacccctaccgtaggtaccttaacgttcccccgacgtacccgtacggggttttaccacggggttcgggaaccggtacggggttcggggttcgttacgggggtaaacgaagggttaactttacctaccttcccgtaccgttaacccagttaccgaccggtaccgaccggttaccctggtacccgtaaggttacccggttaaggtaaacgttttacggttttttagggtttaaaggttttttaacgttttaggttacgttttaacgtacggttaacctttaaagggtttaaacctttaaaccgttaaccggttccgggtttaaccccgtttaccccgggttaaacttttaaccccgggtttttcggggaccccgggttaaccgggggtaaacccgttaacgggtccgggtttaaacgggaaccggtttaaccctaaacgggaaaaacccgtttcggttaacggggtaccgggttacccggttaccgtaccccggttaacccg

SEQ ID NO: 17230 - DNA, 822 bp, Homo sapiens
  misc_feature: GYAE6OF02JZXTC.53.54.E10.1.454.CMB.1.raw
  modified_base (166)..(166): a, c, t, g, unknown or other
  misc_feature (166)..(166): n is a, c, g, or t
  modified_base (297)..(297): a, c, t, g, unknown or other
  misc_feature (297)..(297): n is a, c, g, or t
tcagcgcgtatacacacgaccggtgctcgatttagatcgtagcagaacacacaaagggcacgaccggtgctcgatttagatcgtagcagaacacacaagggggagtaactgctcagttaggacccagacggaaccatggaacgccccagcgcagcttcctcttccncctgctactctggcctcccgagtacgatccgagttggaacgtaaaactgttcgaactcggaccggtctaacggttctcccgaacggtccctaacccgtggttcctggttcgtcctacggaaggggtaaacncgaccaccctcgttcctacggtcgtacgggacccgtacgtacaggtacggtaggttacggacgtaggtccgtaacgttaccgacgttacggtacccgaacggtaaccctaaaaacccgccggtaaccccgtaagggccccgtccccgtacgggtaccctacccgaccttaccgttaacgtgtaccggttaccgacctaccggtaccgaaccccggtaacgggtacctaccgttcggaaccttaccgtccccgtaagtaccccggtacggttaaccgtacggtacccgggtacggttacggttcggggttacccggtacggtaaccgggtaactacggtttaccctaccgttaccggtacctaacccgtaactcggtagaacccgttacgccgttccgacctgttaaaccgtagttaaccgttagggttttaggtacttttaacggttagtaactaccggttcgaacgttacgtacgttaaacttacggtaccttaccgttaccgttacctttccggtaacccggg

SEQ ID NO: 17231 - DNA, 618 bp, Homo sapiens
  misc_feature: GYAE6OF02FZGL5.53.54.E10.1.454.CMB.1.raw
  modified_base (161)..(161): a, c, t, g, unknown or other
  misc_feature (161)..(161): n is a, c, g, or t
  modified_base (255)..(255): a, c, t, g, unknown or other
  misc_feature (255)..(255): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
tcagcgcgtatacacacgaccggtgctcgatttagatcgtagcagaacacacaaaaggggcacgaccggtgctcgatttagatcgtagcagaacacacaagggggaggaactgctcagttaggacccagacggaaccatggaagcccccagcgcagcttcncttcctcctgctactctggctcccagagatcattggagaaatgtagatgacgcagtctccagcccacccgtgtctgtgtctccgaaggggaaancgccacctcctcctgcgacggccagtcagagtgttagcgagacgacttagccgtggtaccagacaaaaacctcggaccgagccgtcccaggcctcctctactcgtacnggcgcacgtacccaccgacggccactgactacncccagccagtcgagtggctgtcggtctcgggacagtaactctacgtntaccacgtacncgtaacgacgtaccgccttacggaccgtacgttaccgtaggtaaacgttagttttacgggtaacgtttttaagtttaggttacgttagtaacgtacgtaaaggtttaagtaaacgtttacgttacggacccgtttaccggttaaccgttaccggttttaccggg

SEQ ID NO: 17232 - DNA, 750 bp, Homo sapiens
  misc_feature: GYAE6OF02F97LM.53.54.E10.1.454.CMB.1.raw
  modified_base (196)..(196): a, c, t, g, unknown or other
  misc_feature (196)..(196): n is a, c, g, or t
tcagcgcgtatacacacgaccggtgctcgatttagatcgtagcagaacacacaaagggcacgaccggtgctcgatttagatcgtagcagaacacacaagggggaggaactgctcagttaggacccagacggaaccatggaagccccagcgcagcttctcttcctcctgctactctggctcccagagatcattgganaaatagtgatggacgcagtctccagcccacctgtctgtgtcctccggaaggggaacgcgaccaccctctcctgcgacgggccacgcgagagtgttacgcaggcgtacgttacgtccgtcggtaaccgacgaaccaaaaaccgtcgggaccgacgggtccctcccggacggtcctaccctactacgttccgttacgtcgggtaccgacgtacgtacccgaccggtaacgggcccgtaacgttcggtaactaccgtaccccaggaacccggttaggttacgtcgggtacggtacggtacgggttcgggttaccgggtagggaaccgtaacggtaactttccgtaccgttacccgttaccaaaccgttacgtacgtaaccggactaccggtacctcgtaccgacggtttaccgtaaaggttaaggttttaacggtttttaaggttacggttttttaacgttacggttttcggaaccgttagtaacgttaacgttaagttaacgttaaccggtccggttaccccgttaccggtttaccgttacggttttaacccgggg

SEQ ID NO: 17233 - DNA, 770 bp, Homo sapiens
  misc_feature: GYAE6OF02IW9ML.53.54.E10.1.454.CMB.1.raw
  modified_base (187)..(187): a, c, t, g, unknown or other
  misc_feature (187)..(187): n is a, c, g, or t
  modified_base (263)..(263): a, c, t, g, unknown or other
  misc_feature (263)..(263): n is a, c, g, or t
  modified_base (399)..(399): a, c, t, g, unknown or other
  misc_feature (399)..(399): n is a, c, g, or t
tcagcgcgtatacacacgaccggtgctcgatttagatcgtagcagaacacacaaagggcacgaccggtgctcgatttagatcgtagcagaacacacgaaggggggaggaactgctcagttaggaccagacgaacatggaacgcccagcgcagtcttctcttcctctgctactctggcctacccaganactcagttggaagaaatagtggatcggacgtcagttctacacgacccacctgtactgtcgtcacggaaggggaacncgacctacctctaccgcgcggacggactagtcagtagtgtacgagtacgacgtactcgcgtacgtaccgataaccaaacgtcggccacgtccaccgacgtctccgataccgtatcggtgacctacactacccgaanacgtacggaccatacgaacttaccgtaccgacgtacgtaacggtacgtacgggtacgggtacgtacgggtacggttacggtaccggggtaacgttaaacggttaaccgttacccgaacgttaccccgtaacccgtaaaccttccgaacgtaccggtaacccgttaggaacccggtacttaacccgggttagttaacccgttaaacggggtttaaagttttacggggttttaaggtttaacggtttttaacgtttaacgggttaccctaaggttaaaccggttaaacggttttaagttaaaccgtttaaaacggttaaccggttcccgggtttaaaccccgtttaaccggtaacccggtttttaacccgggg

SEQ ID NO: 17234 - DNA, 678 bp, Homo sapiens
  misc_feature: GYAE6OF02JSMWY.53.54.E10.1.454.CMB.1.raw
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (433)..(433): a, c, t, g, unknown or other
  misc_feature (433)..(433): n is a, c, g, or t
  modified_base (541)..(541): a, c, t, g, unknown or other
  misc_feature (541)..(541): n is a, c, g, or t
  modified_base (596)..(596): a, c, t, g, unknown or other
  misc_feature (596)..(596): n is a, c, g, or t
tcagcgcgtatacacacgaccggtgctcgatttagatcgtagcagaacacacaaagggcacgaccggtgctcgatttagatcgtagcagaacacacgaggggagaactgctcagttacggacccagacggaaccatggaagccccagcgctagctttactcttcccncgngtctaacttcnggcctaccaggacgntacagttggagaaaacttggcgtancgaccgtnacttccgnaccgcctaaccctggtctcggtcttccgaacgaagggtacacgcctaccgtctccgtgaccgacggtccgaggtcgagtacggtagttagcacgacgtacttacgtccgtcggaactacgaccgtaaaaccgtcggacccgtacgccgtaccgtacgcccgtacctactacgtacgtacgttccgaacgtctaccnccgtaacccgacgggtcctacggtacgtacgttaccgcccacggtaccgtaacgtcggtaacgtcgggacgtacgggtacggtcggtacggtacgtaacgtcgttacnccgttaccgactaccgtataccggactacgcgtagtccggataccgtagtaacgnggtttaacttgttacgtttagttcgacgtgtcgtaaccgagttacaacgttacgtcgacggtttaccgtactacgttaccgg

SEQ ID NO: 17235 - DNA, 885 bp, Homo sapiens
  misc_feature: GYAE6OF02GXTPQ.53.54.E10.1.454.CMB.1.raw
  modified_base (700)..(700): a, c, t, g, unknown or other
  misc_feature (700)..(700): n is a, c, g, or t
tcagcgcgtatacacacgaccggtgctcgatttagatcgtagcagaacacacaaaggtcacgaccggtgctcgatttagatcgtagcagaacacacaagggggagaactgctcagttaggacccagacggaaccatggaacgccccagcgcagttcttctccttcctctgtcctactcgtcgccctaccaggatactactaggttaggaaagtaaagtcggtagtaacgttacggaccgtacgtacgttaccgaccgtaaccggcccccttaaccggtggtttcctaggttaccgttaccgaccggggaaaggggtaaacgacccgtacccctaccccgttccgtaccgtacggtaccgggtaacccggtaccggttaaccggtaaccgtagggtacgggtttacggttaacgccggtaaccgggttcggttaaccgttaacccggtacccggttacggtaacccaaacggttaaaaccgaaaccgggttccggaccggtaccgttaccccgaccggtacggttaccccgttccgttaaacgtcgtaccgtttaacgggccgtaaccggtacctaaccgtcccggaaccgggtacccgtagtacgttaccgaaccgttccctaccgtaccgtacgtaccggtataccgggtcgtacggtggtacgggacggtaacggactaacgttacgaccgttaaccnccgtacgaccttcacggttacgaaccgtctacgtaacgtcgttaacgtacgttacgttaagttacgtttacggtttaagttttccgtaacggttccgaaggttaacggtacttaaacggtttaacctttaccggtaaggttaccgttaacccccgttatttacccgggttccggttaacccgggg

SEQ ID NO: 17236 - DNA, 806 bp, Homo sapiens
  misc_feature: GYAE6OF02FH26G.53.54.E10.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
tcagcgcgtatacacacgaccggtgctcgatttagatcgtagcagaacacacaaagggcacgaccggtgctcgatttagatcgtagcagaacacacaagggggagaactgctcagttaggacccagacggaaccatggaagccccagcgcagcttctcttcctcctgctactctggctcccanagtatcagttcggaanaactgtgatgacgcagtctccagtccaccgtgtctcgtcgtccgtaccgagggaaacgtctccctacctctccgtcgccgacggtccagtacctaaggtaggttacggttacggaccgtaacgtaccgtaacgtttaccggaccgtaccggttaccaacggtaaaccgtaaaaaccggtccggtaaccgtaccgggtaccccgttaccccggacggtaccccttacccgttaccgtaagttacccggttagtaccggggtcccgtacccgaaccgttcccggaacggtacccgggttaccctaacggtccggttaactaacccgtaccctaacgggttcccgtaaacggttccgaagggtttccggaccgtaacggggttcggttaccgggtacggaactaacgttaaccgtacgtacccttcggaccctacgtaccgtgaacccggttcgacccgttcgtacggtaccgttagtaccgttaaagttacggttaacgttttaggggtttaccttaggtttacgttaggtaccgtaacgtaacttaacggttaactacggtttacgtaccggtacccgttttaccgttacggttacgttaccccgggg

SEQ ID NO: 17237 - DNA, 770 bp, Homo sapiens
  misc_feature: GYAE6OF02HSRIX.53.54.E10.1.454.CMB.1.raw
  modified_base (184)..(184): a, c, t, g, unknown or other
  misc_feature (184)..(184): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
  modified_base (544)..(544): a, c, t, g, unknown or other
  misc_feature (544)..(544): n is a, c, g, or t
tcagcgcgtatacacacgaccggtgctcgatttagatcgtagcagaacacacgaaagggggaggaactgctcagtttaggacccagacggaaccatggaagccccagcgcagctttctcttcctcctgctactctgcctccagagatctagttagggaagtaaattaggtcgaatacggacggntacgttctaccagccccacccgttgtcgttgttacgtccgtaccgggaaaggggaacaccgaccctaccttactacgtcggacgaggtcttacgacgagtagttaggtagaccgacgtccgtattacggccgtacggactaacggaaacctaagtcgaacgtcgtccctacgtaccgtccttacctntacttcggtacgtcggacctcttaacccgcccgtaaccgggaacgttccacggtataaccncccgtaccgaccggttaccgttagtccgacgggtcgtacggtacggggttccgggtaacggtacggtaactaaagttccgttccacgtttaccgacctaacgtctaaccggntaaccgtcgtactacgtacgacgttacgtaggtttaacgttttacgtttagtttaacgttttacgttaggttactacgttaaggtaacgttaactacggttaacgttacgttaccgttaccgttaacgttaaccgtttcggtacggtacgttaccgggaagtacggttaccgtaggtaaccgtacgtaacgtaacgtacggttacgtcgtacgtccgttaactccg

SEQ ID NO: 17238 - DNA, 843 bp, Homo sapiens
  misc_feature: GYAE6OF02G3L8J.53.54.E10.1.454.CMB.1.raw
  modified_base (155)..(155): a, c, t, g, unknown or other
  misc_feature (155)..(155): n is a, c, g, or t
tcagcgcgtatacacacgaccggtgctcgatttagatcgtagcagaacacacaaagggggaggaactgctcagttaggacccagacggaaccatggaacgccccagcgcagcttctcttcctcctgctactctggcctccagacgatcattgganaaatgtgactagacgcagtcctaccgacgcccaaccgttggtcttcggttcgtaccttaccgggaaagggggaacaccgacccctaccccttccgttacccgtggacccgtacgggcctaacgtcgaagtggttacgttacggacaacggtccgtaacgttaccggaccgttacggtaaccgaacggaaaccgtaaaaaccgtcggaacccgtaacggtacccgtaccccgaacgggtacccttacccgtaccgttaactacgttaaccggtccgggaccgtaaccttaacccgaaccgtaaccccgtaccggggacccttacggacgttaacgtacctacccgacgtaccgtaacggttacgacggtcggtacgtagggtacgggttcgtaacgggaactaacgtacttaaccgaccgttccgtaacacctttaagaaccgtacgactaccgtacgtacgcgttaacgacgtaagttacgttagttttaacgttaacgtttagtttaccgtacggttacgtacgttaacccgttaaggtttaaaccctaaacgttaaccggttaccgggtaaccctttaactaaccggtttacgtttaccgggacgtaacggaccgttaaacggtaccgtaagggaactaaccgttaacgaaagtttccggtaaggtaccgtagaccttacctacgg

SEQ ID NO: 17239 - DNA, 734 bp, Homo sapiens
  misc_feature: GYAE6OF02GADDC.53.54.E10.1.454.CMB.1.raw
  modified_base (199)..(199): a, c, t, g, unknown or other
  misc_feature (199)..(199): n is a, c, g, or t
tcagcgcgtatacacacgaccggtgctcgatttagatcgtagcagaacacacaaagggcacgaccggtgctcgatttagatcgtagcagaacacacgaagggggagaactgctcagttaggacccagacggaaccagtaggaacgccccagccgtcagctttctcttccctccgtgcctactctcggtcctcccaaggnatcagttggagtaaatgtgaatgacgctacgtcctcgacgccctacctgtccgttgtcgtcctacgggaagggaacgccgaccctacctcgtaccgtcgacgtacgggcctagtaccgaggtaaggttcgttaggacgaggaccgtacgttacgaccgttacggtaaccaacgtaaaccgtaaaaccgtccgggacccgtacgggtacccctaccccggacgtcccccttacggtaccctaagttaccgttaccgccggtaacgaccccgttacgaccccgtaccggaaccgggtaccctaacgttacgaacccgtaccgtaccccgtacggtaaccgtccgtacgacggtacggacgttacgggtcggaacgggtcggacgtaacggtactcgtacgtacctaaccacgtactacgcgtaccgacgtcgtactcggtcttaagtctaaggttttgtcggtttatttcgtaacgttcgtaacgataggttaactaggtacttacgtaccgtaccgtaacttcggtaccggttcgg

SEQ ID NO: 17240 - DNA, 747 bp, Homo sapiens
  misc_feature: GYAE6OF02HL0WX.53.54.E10.1.454.CMB.1.raw
  modified_base (218)..(218): a, c, t, g, unknown or other
  misc_feature (218)..(218): n is a, c, g, or t
tcagcgcgtatacacacgaccggtgctcgatttagatcgtagcagaacacacgaaagggggaggaactgctcagttaggacccagacggaaccatggaacgccccagcgcagcttctcttcctcctgctactctggctacccagagatcagttaggagtaaatagtgatgacgcagtctaccacgtccacctgtctgtcgtcctacggaaggggaacncgaccctaccctctcctagccgagggacctaggtacaggtagttgtagacgacgtacgtacgttacgccgtacggtaccacgaaacctaaaaccgtcggaccaacggtcctaccgtaacggtcctacctctacttacgtacgtcggtccactaaccgtaccgtaaccggacggacctaacgtcgtacttaccgtacccgacgtccgtagttacgtacgtaggtaccgtagggtacggtcgtaacggaacgtaacgttacgttactacgtacctaccgtaactagtacgacgtaccgacgtcgtacgaccggtacgttacgtaacggtaaggtttttaccggtttagttaaactttttagtacgttcgtacggtaaacttaccggtaagttaaaccttagtaaccgtagttaacccgtacgtttacttaacgggtttccgggaacggaccgggtaaccgtaagggtaccgttaacggtaagtaccgtaaacgtaaaggtccggtcggttaggacctaccgtacgttaacg

SEQ ID NO: 17241 - DNA, 760 bp, Homo sapiens
  misc_feature: GYAE6OF02JJKQJ.53.54.E10.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagcgcgtatacacacgaccggtgctcgatttagatcgtagcagaacacacaaagggggaggaactgctcagttaggacccagacggaaccatggaagccccagccgcagcttctcttcctctgctactctgggcctcccagagatcattgggacaaatagtgatgacgcagtctaccagcccaccctgtctgtcgtctaccgaggggaaagcncccacctcncctgccgagggcctaagtccagtacttggtagcacgcgtactagtcctcggttaaccagaaccgtaaaaccgtgacccgacggtcctaccgtacggtcctacccgtccgacttcgtaggttaccggccgaccgtactaccggacccgtaacggggtaccncgtacgtacgtacctaccgcgacgtacggtttctacggnggtcgaagggtcggtacgtacggaacgacggttacgttcctacgtcgtcgacccgtaagtcgtaccggctaacccggtcgtacgacgtacggttacgtacgtaaaggttcggttttagttacgttttacgttaacgtttaccgttagacgttacgaaaggtttaaacgttaaaccgtaaccggttacgtttaccccgttacggttaaaccccgtttacggttttacccggaccgggtaacggggttaacctccggttaaccggtacgggaaggttacccttaaaacgggaaccccgttaggttaacccgtggggaaccccttcggacccgttaaccg

SEQ ID NO: 17242 - DNA, 659 bp, Homo sapiens
  misc_feature: GYAE6OF02J0LM2.53.54.E10.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (472)..(472): a, c, t, g, unknown or other
  misc_feature (472)..(472): n is a, c, g, or t
  modified_base (524)..(524): a, c, t, g, unknown or other
  misc_feature (524)..(524): n is a, c, g, or t
tcagcgcgtatacacacgaccggtgctcgatttagatcgtagcagaacacacaaagggcacgaccggtgctcgatttagatcgtagcagaacacacgaagggggaggaactgctcagttaggacccagacggaaccatggaagccccagcgcagcttctcttcctcctgctactcgtgctccngagatcgattggaanaatagtgactgacgcagttctccacgcctacccgtgtctgttcgtccttacggaaggggaacacgccctaccctcctccgtagaccggacgggcctagtaccgagacgttgtaacgcgagccgtacgttacgccgtggtaacacgtaaccgtaaaaccgtcggacccacggtcctacccgacggtccttaccgctactccgttagaccggcgtactctaccggacccgacggtaccgaacttcgaaactttccaccgaacccgtgtaacggttnaacggttccgacggtaacgggttcggtaccgttaggaacgtacgtaacgtcnccggtactcgtacacgacttacggactctcgtcgctaacgttcgaagtaaccgttgtttaacggtatttactttaggcttaccgagtcctaagttacgtagtaccggtcgttacctaccgttgtccgtttaacgg

SEQ ID NO: 17243 - DNA, 914 bp, Homo sapiens
  misc_feature: GYAE6OF02H9BKB.53.54.E10.1.454.CMB.1.raw
  modified_base (100)..(100): a, c, t, g, unknown or other
  misc_feature (100)..(100): n is a, c, g, or t
  modified_base (145)..(145): a, c, t, g, unknown or other
  misc_feature (145)..(145): n is a, c, g, or t
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagcgcgtatacacacgaccggtgctcgatttagatcgtagcagaacacacaaagggggaggaactgctcagttaggacccagacggaaccatggaacnccccagcgcagcttctcttcctcctgctactctggctcccagagntcagttggataaatgtacgatcggacgntagttcnccagccacctgtctagtcgtctaccggaagggtaacncgtccctaaccctntacccgtgaccgacgggtacctacggttcaaggtaggttcggttaacgcgtacggtaccggttaacgttacgtaccgttacggtaccgacggtaaacctaaaaccggttcggaccgtaacggtccctacccggtacgtaccttacccgtctaaccgttcgttacgtccggaccgtaccgtaccgttacccgaaccggtacccgggaccttaacgtacgtaccgtaccgttacccgacgtacccggttacggtactaggtacggtacggtacggttcgggttacggtacggtaaccgtaacggtaacttaccggtacctccgtaccctaacgttaccgtacgtccggaacgtaccggttccttacggacgtttaacgggtacgttaacggttaacggttttacggttttacgggttaatttttaaccgggttactttaacggttacgaaccgtttaaccggttaacggtttttaaacgttaaaccgggttaccggttttacccgggttacccgttaacccggtttaaaccggttttaaccggggttttcccgggaacccgggttacgggttaaaccccggtgggttaacccgggttacgggtaaacccggtttacggtaaaccggtaccggttacggggttccgtttaacccggggtaactttcccggaaaccccggttttacg

SEQ ID NO: 17244 - DNA, 531 bp, Homo sapiens
  misc_feature: GYAE6OF01BE24V.44.34.D01.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (396)..(396): a, c, t, g, unknown or other
  misc_feature (396)..(396): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggngagtcaggccattagcaattattagcctggtatcagcagaaaccagggaacctcctaacctcctgatctttgctgcatccactttgcaatcagggtcccatctcggttcagcggcagtggatcgtgggactagtatttctctctcacatcagcagcctgcagcctgaagnttgttgactaacttattactacgtaacaaagtacaactacgtcgcccctactaaccgtaccgtttaccgggaccccgttacgggaaacctaaaggtacggaacttaactaacgtaaaacggtaacgtggttacgg

SEQ ID NO: 17245 - DNA, 564 bp, Homo sapiens
  misc_feature: GYAE6OF01CESCN.44.34.D01.1.454.CMB.1.raw
  modified_base (199)..(199): a, c, t, g, unknown or other
  misc_feature (199)..(199): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgganacagagtcaccatcacttgccgggcagtcaggccattagcaattatttagcctggtatcagcagaaaccagggaaacctcctaacctcctgacttcttgctgctatccacttgacaatcgagggtcccatctcgttcagcgcagtgatcgtggacagtatttactctctcacatcccagcagtcctgccagccgtagaacgtagtcgttacgacctaacgtttaacttactacgttaacaaaagttaccaaacgtacgtaccgtaccccgtactaacccgtaccgttttacccggacccgttacgggaaccctaaaacgggttgtaaacttaactaaccgaaaacccggtaagttggttacccgg

SEQ ID NO: 17246 - DNA, 223 bp, Homo sapiens
  misc_feature: GYAE6OF01CCL1X.44.34.D01.1.454.CMB.1.raw
  modified_base (221)..(223): a, c, t, g, unknown or other
  misc_feature (221)..(223): n is a, c, g, or t
tcagacagtatatacacgaccggtgctcgatttagatcgtctgtgttgggtctggggcaaagggaccacggtcaccgtctcctcagcctccaccaagggcccatcggtcttccccctggcgccctgctccaggagcacctccgagagcacagcggccctgggctgcctggtcaaggactacttccacgtctactgctgagcgggctggcaaggcgcatagnnn

SEQ ID NO: 17247 - DNA, 628 bp, Homo sapiens
  misc_feature: GYAE6OF01AHIZO.44.34.D01.1.454.CMB.1.raw
tcagacagtatatacacgaccggtgctcgatttagatcgtctgtgttgggtttgggggcagaagtctctctcagtcaggacacagcatggacatgagggtccctgctcagctcctgggactcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggacgtcccagccaggttcagcggcaggtggttctgggacactatttcactctcaccatcagcagcctgcagcctaggagtactttcgacgtactttattacctgaccctaaactaattacttttacctttttttacgtacccgtttaacgttacggtttttcgggacccgtaagggggtacccctaaagggtccgttaggggtaaacgtaacgttaaccggaaaaaggggttaaccttcgggttacgggtaccttacgggaccctaacccgttaagtttcccgtttcggtttacccttttaacccg

SEQ ID NO: 17248 - DNA, 642 bp, Homo sapiens
  misc_feature: GYAE6OF01CUTXG.44.34.D01.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgganacagatcacatcacttggccggnagtcaggccattagctaattntttanccgtgtatcagcaacgaaacgaggaaacgtctacctaagctacctagactactatagaaactatcctaattttcgactaaagtccgaacgggtccctagtcgtcggttacaggtcggacgtaggtacgagttcggtaggtactagtactttaccactcgtaccaccgttacacgtaccgacggtccttacggacgtacgaccgttacggaagtacgttaggtttaccggtaaccttaaacgtttaacgttaacgttacgttaaaacgtaaaacgttaactaaaccgtaacgttacccggtaccccttaacgtaaccccgttacgtttaccccgggacccgttacgggtaaccctaacgtacggtacggattaacgtaccgaaggttcgtaacgg

SEQ ID NO: 17249 - DNA, 513 bp, Homo sapiens
  misc_feature: GYAE6OF01AUJD0.44.34.D01.1.454.CMB.1.raw
tcagacagtatatacacgaccggtgctcgatttagatcgtctgtgttgggtttgggggcagaagtctctctcagtcaggacacagcatggacatgagggtccctgctcagctcctgggactccttctgctctggctcccagatactagatgtgacttccagatgacccagtctccatcctccctgtctgcatctgtgggagacagagtcaccatcacttgccgggcagtcaggccattagcaattatttagcctggtatcagcagaaaccagggaaacctcctaacctcctgatctttgctgcatccactttgcaatcaggggtcccatctcggttcagcggcagtggatcgtgggacagatttctctctcaccatcagcagcctgcagcctgaagatgttgcaacttattaacttgtacaaaagtacaacagtcgccccttacacctaaccgtttccggcccttcggggacccacgagttacgggactagtacaacgacggtaacgtacggg

SEQ ID NO: 17250 - DNA, 665 bp, Homo sapiens
  misc_feature: GYAE6OF01C4OF6.44.34.D01.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccggnagtcaggccattagctaattattagcctaggtatcagcaacgaaaccacggaaaacctcctaaacctcctagtattctttagcttcgactactcctactttgactaatcgacgggtcccagttcgtcggtcaggcgctaggtggactcgtagggacagtactttctctctaccaaccgtatcacgacacgtcctcgaccacgtcctagaacgtattcggttacgtaccttaaacttttacgttaaccttaaggtaaacctaaaacggttaccctaaacgtaccggttaaccccgtacccccttaaaccgtaacccgtttaaacccggtttaccccgggtaaccccggttaaacggggtaaaacccgttaaaacgggttaacggtaaactttaaaacccgtaacccgtaaaaacccgggttaacttcggggttaaacccgg

SEQ ID NO: 17251 - DNA, 594 bp, Homo sapiens
  misc_feature: GYAE6OF01BU7BQ.44.34.D01.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccaggttcgagatgtgacatcgagatgacccagtctccttcttcctgtcttcttctgttggagcagcgtcaccatcacttgccgggcagtcaggtcgttttcggtgctgttgcctggtttcaacgaaaagggggnaggcccctaaggtcctcgtctctcgtagaaaccngactggaaggtagagtcccgtcaggttcagtcgccagtccagggtggtgggccgagtccactctcacctattagcgacctgcggcctagaagtattcagctaactttatttctgtacagtcagtatcatacgtcgtccccgttctacgttttcggaccgtaacggggacctaaacggtccgtaaggtaaaacttaccgaaaaccggtaaccgttggtacgggtaccttacggacccaacctacgttccgttacggttacctttactaacttcccgttaccccgtaccc

SEQ ID NO: 17252 - DNA, 619 bp, Homo sapiens
  misc_feature: GYAE6OF01AP3UV.44.34.D01.1.454.CMB.1.raw
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
tcagacagtatatacacgaccggtgctcgatttagatcgtctgtgttgggtttgggggcgagaagtctctctcagtcaggacacagcatggacatgaggtccctgctcagctcctgggactcctgctgctctggctcccagatactagatcgtgacttccagatgacccagtctccatcctccctgtctgcatcgtgtgggacacagacgtcaccatcacttgccgggnagtcacgccattagcaattattacgctggtatcagcaagaaaccgaggtaaccctctaaccgtctagtatctttgactgactactacctacttanactaatccgtacgggtaccctattcgtccgttacgacggccgtcgtaaggttcggattcgggacgggtaacagttactttcctacgtctcgtaaccctntaccgactacgacctccctaggtccacggtccaggtaancgtttcgttacgaacttaacgttccttaacgtggtaaccaaacgtacaaacgtccgtaccgtaccccctagtaacccgttccggtttaccgggcccttaacggggaaccttaaggtcgtaacgttactaacccggaaacgttaaccgttcggtacgg

SEQ ID NO: 17253 - DNA, 640 bp, Homo sapiens
  misc_feature: GYAE6OF01BHVUK.44.34.D01.1.454.CMB.1.raw
  modified_base (201)..(201): a, c, t, g, unknown or other
  misc_feature (201)..(201): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtccaccatcacttggccgggcgagtcaggccattagcaattatttagcctggtatcagcagaaaccagggaaacctcctaaacctcctgatctttgctgcatccactttgcaatcagggtcccatctcggttcagcgcagtggatcgtgggactagtacgttttcctcgttcctaccacctacgtacgacgtaccgtaccgtccgttacgaccgtaccgtaccgtaaggtaacgtagtttacggttacgtaaccgttaactttaactttaccgttaacgttaaactaaaacgtaaccgtaaacgtacgtaccccgtacccctaccgtaaccgttacccggtttaccccggtacccggtacccgggtaaaccgtaaacggttacggtaacgttaacctaaaccggtaaaaccgttacggtagggttaacccggg

SEQ ID NO: 17254 - DNA, 729 bp, Homo sapiens
  misc_feature: GYAE6OF01BQ5CD.44.34.D01.1.454.CMB.1.raw
  modified_base (205)..(205): a, c, t, g, unknown or other
  misc_feature (205)..(205): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttcagatcgacccagtctccatcccgtcctgtctgccatcgtggtggganacagacgtcaccatcacgttcggccgggcacgtcacggcctagttagctaattactttagcttaggtatcagacaacgaaaccgacggaaaccctccgtaacctctagtactttcgttagctacgtactacttacctactttacgactaacgtaccgtaacggggttccctaacgttccggtttaccgggtttacaacgggccggtacggtacgggttaggtacgttaccgggtagggtaacgttacggtttaaccttttccgtaccgttacgtaccctaaaccgttaccgttaacgaccgtaccgtaacgggtcccttacggaccgaccggtacccgtaaggtaacgttacgttacgttaccgaaccttttaacttaacgttaacgtttacgtaaaacgtaaaccgtaaccaaccgtacgtaccccgtacccttaacggtaccttaccggttaccggtacccgttaacccgaaacgttaacggttacgtacttaaacctaacgaaactaacgtcgggtaaccg

SEQ ID NO: 17255 - DNA, 642 bp, Homo sapiens
  misc_feature: GYAE6OF01EVUEX.44.34.D01.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccaggttcgagatgtgacatcgagatgacccagtctccttccttcctgtcttcttctgttggaggcagcgtcaccatcacttggccgggnagtcaggttcgttttcggncttgtgcctggtttacaaacgaaaagggggnacggccccgtaaggtccttcgtctcgtcgtagaaaccagacgtaggaaggtagacgtcccgtcgtaggttcagtcgcctagtccgagggtgggcgggccgacggtcccactctaccacctagttacgccgtaccgtcggccggaccttaggtaacgtacgtttactcgaccttaacttttatttcctgttcaacgtacgtagttactctaacgtacggtccgtcccccgtttataccggttttcgggacccgtaacgggggaacccaaggtccgtaacggtaaaatacccgaaaaacggtacttagggtcgcgttacgactaccaagttccttacggttcttaccgtacttcccgttcccgtacc

SEQ ID NO: 17256 - DNA, 649 bp, Homo sapiens
  misc_feature: GYAE6OF01AY67J.44.34.D01.1.454.CMB.1.raw
  modified_base (202)..(202): a, c, t, g, unknown or other
  misc_feature (202)..(202): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatccctccctgtctgcatcgtgtggganacagagtcaccatcacgttggccgggcgagtcgaggccattagcaattattagcctgtatcagcagaaaccagggaacctcctaacctcctgactctttagctgctatcctactttcgcaagtccgtagggtcccacgttctaccggtttcacggtccggacgtacggttaggaacgttccggacggggtaactacggttaacttttccttccctactaccctactacgtacgacgtaccgaccgtcaccgactaccgacgtaacgagttcgttaggtactaacgttaactttaacgttacgttaccgtaaaacgttaacgaaccttaacgtccgtaaccctacccgttaacctaaccggtttcccgttacccggtaaccggttaacccgaaaggtaaccggttaacgtaactaacccgtaaaccgtaaacgtcgttaggtaacccg

SEQ ID NO: 17257 - DNA, 715 bp, Homo sapiens
  misc_feature: GYAE6OF01D56HY.44.34.D01.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
tcagacagtatatacacgaccggtgctcgatttagatcgtctgtgttgggtttgggggcagaagtctctctcagtcaggacacagcatggacatgagggtccccgctcagcctcctggggcctcctgtctactctggctccgaggtgccagatgtgacatccagatcgacccagttcctccttcctcctgtctgtcttactagtaggagacaggacgtccgccatcacgttcggccgganagtacacgacctattaacngtacttaatttaaagtgtatcagacagacgaccgaaggaacnccgtagacctcgtagntcgtctcnctcgtcctactactcgtagcgtaagggtgtacgttctcgttacgtaacggtttcgaggtcggacgtaggtacggtacgttcggtagggtacttaacggttactttcccgtaaccttccttacccgtaaccttacgttaccctacccgtacggttaccctacggtaacccttaaaccggtacgttaaagtttcttttacccggaactttaaacccgttacgttacgttacgaaccgttaaacggtaagttttaaccttaccgtacccgttccggttaccccgttttacggtaaccgggtttaccggggacggggaaccttagggtaccgtagggtaacccacgttaaacgaaaccggttacggtcggttaacgccttacggacccttaacg

SEQ ID NO: 17258 - DNA, 828 bp, Homo sapiens
  misc_feature: GYAE6OF01AK7Z2.44.34.D01.1.454.CMB.1.raw
  modified_base (254)..(254): a, c, t, g, unknown or other
  misc_feature (254)..(254): n is a, c, g, or t
tcagacagtatatacacgaccggtgctcgatttagatcgtctgtgttgggtttggggcagaagtctctctcagtcaggacacagcatggacatgaggtccctgctcagctcctgggactcctgctgctctggactcccagatactagactgtgaccttccagtatcgaccccagtcctcctagtccctcccgtgtctgcctattcctggtaggacgacgacgacgtccaccctattcaccgtttgcccgggtanggttccgaggacccgtaagttacggaccttaaatttactttacgtccgttagggtacttacgaacgtacaaggtaaaaccccgtacgggtaaacccttccctaaacccgttcctacggtaactttcgttttacgccgttacgtaccgtaactttccgtacgttttaccgtaacgtaaacggttcccggtaaccggggttcccctacgtttaacccggtcggtttaccgaaccggttccggaccgttaaggtcggtaacttaccgggtacggaacgttacgtacttttccttacggtacctacggtaacctaccgtagtacccgttaacgccgttacccttaacggcctttaaccgggacccttaaggaacggttaaccgtttacgtttaaccggtaacccttttaaacgttaacgtttaccttaacggttaccgaaacgttacggttaacggtttacccttcggttaaccccggttacccgtttacgggttaaccgtttccgggggtaacggttaaccccgaagtcccgtaacgggtacgtaaacctaaccgggtaactaaccggtttgaccgg

SEQ ID NO: 17259 - DNA, 857 bp, Homo sapiens
  misc_feature: GYAE6OF01CCC5N.44.34.D01.1.454.CMB.1.raw
  modified_base (636)..(636): a, c, t, g, unknown or other
  misc_feature (636)..(636): n is a, c, g, or t
tcagacagtatatacacgaccggtgctcgatttagatcgtctgtgttgggtttgggggcgagaagtctctctcagtcaggacacagcatggacatgacgggtccctgctcagctcctgggactcctgctgctcgtcggcctcccgagactacgtagtatgtacgtaccttaccgagtactaccggaacccctacgtccctaccctacttccccttcccgttgtcctcgctacttaccggtggtacggggaacgacgacggtacgtacccaaccctacgttaccgtaaccggttccgggacccgggggtacggacggttaccgaacgggtaccctaagttaacgaaccttaaagttttacgtttaccggtacgttaaggtaacctcgaacgaaccgaaacggaaaccccgtaaccggtaaccctaccctaacctacctagttacgtacgtttacgtacgtccgacgttacctaccgttcctacgtcgaacgttaccggtccggtacccggtaccgttaccgttaccggttaccggacggtacggacggtaggtacggtacgtccgggtacggtacgtacgtttaccttcccgtttccgtacccttacgtaacccgtacgtacaaccggtcggtaccncccggtcgttacggacctaccggtaagtacggttacgttgtaacgttaccgttaactttacggttactaacggttacctaaacgacccgtaccggtacttaccccggtaccctaacccgttacccgtcggttaccccgggtaacccggtaaacgacccgttaaacgggaccttaaccgggtaaaccttaaacccgtaccggtacggttaaggttccccggg

SEQ ID NO: 17260 - DNA, 809 bp, Homo sapiens
  misc_feature: GYAE6OF01DETU1.44.34.D01.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
tcagacagtatatacacgaccggtgctcgatttagatcgtctgtgttgggtttggggcagaagtctctctcagtcaggacacagcatggacatgaggtccctgctcagcctcgtggactcctgctgctctcgctccagactatagatgtagtacttcagactcgaccngtcctcacgtccctccgtgtctgactattcgtggngggacacgtagacgtccacntccagttcgggccggagacgtacgacggacctaagttacgtaccgttaatttacgtttacgtacgttaggtactacgacgaccgtaaacggaaaccggtaaccgggtaaaccccttacccgttaaaccccgttccgttagttacttttccggtttacgtaccgttcccgtaccttaccgttccccgttaacgtttacgaaccggttaaccggttaccgggttaacccggggttaccccttacggttcccggtttacgtacccgggtacggtacccggtacggtaccggtttaggacctttaccgggtacgggtactttaaccggttaacgtttttcccgtaccttaccttaacccgtataccggtaccgtactacccggtaccgtaaccgtcgtaccgaaccggttacgtacggtaacttacggttcgttaacgtaaccgttttaacttacggtttaccgtaaacgtaccgttaaacctacgaaccgtaccgtaccctaccgttaaccgttacggtaccccgttacccgggtaactaccgggtaaccttaacggattaacgttaaccgagtaaacctgtcgggtac

SEQ ID NO: 17261 - DNA, 234 bp, Homo sapiens
  misc_feature: GYAE6OF01ELUUH.44.34.D01.1.454.CMB.1.raw
  modified_base (227)..(234): a, c, t, g, unknown or other
  misc_feature (227)..(234): n is a, c, g, or t
tcagacagtatatacacgaccggtgctcgatttagatcgtctgtgttgggtctggggcaaagggaccacggtcaccgtctcctcagcctccaccaagggcccatcggtcttccccctggccgccctgctccaggagcacctcgagagcacagcggccctgggctgcctggtcaaggactacttcctcgatcgcgtctggaggcgggctggacgaagggcgcagtagnnnnnnnn

SEQ ID NO: 17262 - DNA, 657 bp, Homo sapiens
  misc_feature: GYAE6OF01EV86M.44.34.D01.1.454.CMB.1.raw
  modified_base (175)..(175): a, c, t, g, unknown or other
  misc_feature (175)..(175): n is a, c, g, or t
  modified_base (214)..(214): a, c, t, g, unknown or other
  misc_feature (214)..(214): n is a, c, g, or t
  modified_base (422)..(422): a, c, t, g, unknown or other
  misc_feature (422)..(422): n is a, c, g, or t
  modified_base (478)..(478): a, c, t, g, unknown or other
  misc_feature (478)..(478): n is a, c, g, or t
tcagacagtatatacacgaccggtgctcgatttagatcgtctgtgttgggtttggggcagaagtctctctcagtcaggacacagcatggacatgacgggtccctgctcagctccgtgggactcctgctcgctcgtcggctcccagactaccagatgtgacatccagatcgacccngtcctcctactccctcctgtctcgcactcgtggtagganacgagtactcaacctactcctacgtcggccggtagacgtcgaggactaagttagacttaatttacgtacgtccgttagtactaccgaagaccgaaacggaaaccggaggtaactccgtacgtaacgccttaccgtagtactacttaacgtacgaaactctaccttagttacacgtagtcgacggtctagtccgtcgtacgacggacgngtagtgacgtcgtacgactactacttccactacactacactacacgtacactccgngaccgtacgtccgaagtcttacgttacgtacgttacttacgtccgtaactaaccgtactttaagtttaccttttaccgtttaacgttaccgttacggtttaccggttacgggaaccgtaacggggtaacctacgggtaagtacggtaaacgtacccgtaaacggtaagttcgtaacggg

SEQ ID NO: 17263 - DNA, 493 bp, Homo sapiens
  misc_feature: GYAE6OF02G0AKX.44.34.D01.1.454.CMB.1.raw
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaattatttagcctggtatcagcagaaaccagggaaacctcctaacctcctgatctttgctgcatccactttgcaatcaggggtccatctcgttcagcgcagtggatctgggacagatttctctctcaccatcagcagcctgcagcctgaanatgttnctaacttattactagtacaaaagtacaactagtcgacccctnacctctttaccgcccgtagggaccaagtgactatacaaacgtactagtacgg

SEQ ID NO: 17264 - DNA, 491 bp, Homo sapiens
  misc_feature: GYAE6OF02GG4AP.44.34.D01.1.454.CMB.1.raw
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaattatttagcctggtatcagcagaaaccagggaaacctcctaacctcctgatctttgctgcatccacttgcaatcaggggtcccatctcggttcagcggcagtggatctgggacaggatttctctctcaccatcagcagcctgcagcctgaagatgttgctaacttattactgtacaaaagtacaacagtncccctanacctctttaccgcccgtggaccaaagtggatatacaaacgtactgtacgg

SEQ ID NO: 17265 - DNA, 516 bp, Homo sapiens
  misc_feature: GYAE6OF02H5TGF.44.34.D01.1.454.CMB.1.raw
  modified_base (201)..(201): a, c, t, g, unknown or other
  misc_feature (201)..(201): n is a, c, g, or t
  modified_base (451)..(451): a, c, t, g, unknown or other
  misc_feature (451)..(451): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcgagtcaggccattagcaattatttagcctggtatcagacagaaaccagggaaacctcctaacctcctgatctttgctgctatcctactttgctatcgacggggtccatctcggtcagcggcagtggatcgtgggacagtactttctcttctcaccatcagcacgcctcgcacgacctgagagtgtcgactaacttattactagtaacaaaagtacaacagtaccncccgtacacgtctttaccgccgtacggaaccaaggtacgtactactaccaaacgtacgtgtacgg

SEQ ID NO: 17266 - DNA, 518 bp, Homo sapiens
  misc_feature: GYAE6OF02INNHU.44.34.D01.1.454.CMB.1.raw
  modified_base (261)..(261): a, c, t, g, unknown or other
  misc_feature (261)..(261): n is a, c, g, or t
  modified_base (355)..(355): a, c, t, g, unknown or other
  misc_feature (355)..(355): n is a, c, g, or t
  modified_base (448)..(448): a, c, t, g, unknown or other
  misc_feature (448)..(448): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttggccgggcagtcaggccattagcaattattagctggtatcancagaaaccagggaaacctctaacctctgatctttgctgcatccactttgcaatcagggtcccatctcgttcagcgcagtggatctgggactagntttctctctcacatcagcagcctgacagctgaagatgtgactaacttattacttgtacctaaaagtacaaaacgtagtcgacccctactaccncgttttacccggacccttacgggacccgtaaaggtcggaacttaacctacaaaccggtaccgtagtacgg

SEQ ID NO: 17267 - DNA, 596 bp, Homo sapiens
  misc_feature: GYAE6OF02IE720.44.34.D01.1.454.CMB.1.raw
  modified_base (275)..(275): a, c, t, g, unknown or other
  misc_feature (275)..(275): n is a, c, g, or t
  modified_base (395)..(395): a, c, t, g, unknown or other
  misc_feature (395)..(395): n is a, c, g, or t
tcagacagtatatacacgaccggtgctcgatttagatcgtctgtgttgggtttgggggcagaagtctctctcagtcaggacacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngaggcccctaaggtcctcgtctctcgtgaaaccagactggaaggtgagtcccgtcaggttcagtgccagtccaggtggtgggccggagtccactctcaccattagcgacctgcgctgagnttctgcaacttattctgtcagtcagtatcatagtcgtccccgttctaccgtttttcggcccgtaacgggggtaacccaaggtaccgtagggtaaaacttaccgtaaaaccgtaaccgttacggtacgggtaccgttcggtaccaacccgtacgttccgttcgttacctttcctacgttcccgtttcccccgaccttaaccg

SEQ ID NO: 17268 - DNA, 497 bp, Homo sapiens
  misc_feature: GYAE6OF02FE3GL.44.34.D01.1.454.CMB.1.raw
  modified_base (226)..(226): a, c, t, g, unknown or other
  misc_feature (226)..(226): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggnagtcaggccattagcaatatttagcctggtatcagcagaaaccagggaaacctcctaaacctcctgatctttgctgcatccactttgcatcaggggtccatctcggttcagcggcagtggatctgggacagattctctctcaccatcagcagcctgcagcctgaagatgttcgctaactttattactagttacaaaatacaactagtcgcccctacacctactttccggcccgtgggaacccaaaggtcggaatatacaacgactgtacgg

SEQ ID NO: 17269 - DNA, 608 bp, Homo sapiens
  misc_feature: GYAE6OF02JLLPQ.44.34.D01.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggngagtcaggccattagcaattatttagcctggtatcagcagaaaccagggaaacctcctaacctcctgatctttgctgcatcacttgcaatcagggtccatctcgtcagcggcagtggatcgtgggaccagtactttctcttcctcgaccctatcctacgaccagacccgttcgacacggtccctaggtaacgatttcggttgtaccgtaactttaactttacgtaggtttaactaaaaacgttaaccgaaactacggtttacccggacccccttacgaacccgttaacccgttttaccgggaccccgttacgggggaaccctaaaagggttacgggtaacttaacgtacccgaaaacccggtaaccgttcgggtaaccgggg

SEQ ID NO: 17270 - DNA, 502 bp, Homo sapiens
  misc_feature: GYAE6OF02IQGU1.44.34.D01.1.454.CMB.1.raw
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttggccgggcgagtcaggccattagcaattattagcctggtatcagcagaaaccagggaaacctcctaacctcctgatctttgctgcatccactttgcaatcagggtccatctcgtcagcgnagtgatcgtggacagtatttctctctcaccatcacgcagcctgcacgctaganatgtgactaacgtttattactagtaacaaaatacaaagcgtaccaccctctacctcgtttaccgacccgtacggacctaagtaggacttaacgacaacgtacgtagtcgg

SEQ ID NO: 17271 - DNA, 518 bp, Homo sapiens
  misc_feature: GYAE6OF02FL1YZ.44.34.D01.1.454.CMB.1.raw
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaattatttagcctggtatcagcagaaaccagggaaacctcctaacctcctgatctttgctgcatccacttgcactcacggggtccatctcgtcagcgcagtggatcgtggactagtntttctctctcaccatcagtcagtccngcncgctagatctgttcactacttattactagtacgaaataccaacgacgtccgtccctacacgttaccgttaccggtccccgtagggaacctaaaggtcggtaactaacgtacgaaacgtacgtggtaccgg

SEQ ID NO: 17272 - DNA, 672 bp, Homo sapiens
  misc_feature: GYAE6OF02IHRQ2.44.34.D01.1.454.CMB.1.raw
  modified_base (224)..(224): a, c, t, g, unknown or other
  misc_feature (224)..(224): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctccagatactagatgtgacttccagatgacccagtcctcatcctccctgtctgcatctgtggagacagagtcacatcacgttgccgggnagtcaggcctattagactaattagttacgcctggtatcacgacaagaaaccgaacgggtaaccctcctaaccctcctagtactctttgactcgctactccctacttttcgactaactccggtacggggttcccctagttccgttcggttaccacggtaccggacgtaggttcggtacttcgtacgggtacgtagtacttttccgtactcctacacctactcgacgtaccgtacgtcctcgacctacggtaccctagtaaacgtacgttacgttacgtaactttaactttaacgttaccgttaacgttaaacgtaaaaccgtaccgtaaacgtaccgtaccgtacccccgtacgtaccgttaaccgtttcccgggtaccgtaccgggtaaccgtaaaacggttcggtaaaccgttaacgtaaccgtaaaccgttaccggtaggtaccgg

SEQ ID NO: 17273 - DNA, 678 bp, Homo sapiens
  misc_feature: GYAE6OF02GVA30.44.34.D01.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctggtggganacagagtccaccatcacttgccgggnagtcaggccattagctaattatttagcctggtatcagcaacgaaaccgacggtaaccctacctacctcgtatacttcgtgtctcgactactcctacttcgactacgtacgggacggtaccctagttccgttcggtacgacggtccggtacgtaggtcgtacgtcgggtaggtaacgtaacgttactttccgtacttacctcccgtaacctactaccggacgtaccgtaccgtccggtaacgtccgaaccggttcgtaaaggtacgttaaggtttcgtaacgttaacctttaacgtttaagttacgttaacgttaaacctaaaacgtacccgtaaactaccggacccttacccgtaaccttaccgtttacccgggttcccggtacccggtaacgggtaaaccgtaggttacgtacgtaaaccgtaaccggtaacgttacggtggtacccgg

SEQ ID NO: 17274 - DNA, 548 bp, Homo sapiens
  misc_feature: GYAE6OF02GMFR6.44.34.D01.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgcgggcgagtcaggccattagcaattatttagcctggtatcagcagaaaccagggaaacctacctaacctcctgactctttcgctgcnttccactttgcaatcaggggtcccatctcgttcagcgcagtcggagtcgtgggacagtactttcgtcttctcaccatcagtcacgcttcgacacgcctagaagtattggttgacctaactttacttacgtgtaacaaagtacaaacgtacgtccgtacccctactaccgtccgttaccggtacccgttacgggaacccgtaaggtacggtactataaccgtaaaccgtacgtggtaccggg

SEQ ID NO: 17275 - DNA, 832 bp, Homo sapiens
  misc_feature: GYAE6OF02HMU5M.44.34.D01.1.454.CMB.1.raw
  modified_base (249)..(249): a, c, t, g, unknown or other
  misc_feature (249)..(249): n is a, c, g, or t
tcagacagtatatacacgaccggtgctcgatttagatcgtctgtgttgggtttgggggcagaagtctctctcagtcaggacacagcatggacatgagggtccccgctcagctcctgggctcctgctgctctggctcccgaggttcgagatgtgacatcgagatcgacccagtcctccttccttctgtcttcttctgttggagcagcgtcaccatcacttggccgggcgagtccagggttcgttttcggngtctggttcgccgttagggtttaccaaaaacggtaaaaaggggggctaaccgggtaccccccgttaaagggttccccttcggttccttccgtacggttacgaaaacccaggtaccgtagggaaacggttacgaccggttcccccgtacctagggtttaccaggttccgaccgtaaggtcccgtaagggggtccgggtacggggcccggtaacgtcccaacgttccgtacctaacccgtagtttaaccggccgtaaccgttcggccggtacctaggtaacgtcgtttaccgtcggtaacccttaaacgttttacgtttccgtacggttacgtacggtacgttacgttaacttaccgtaacgttacggtacccggttccccgttttacgttaacccggtttttacgggacccggttaaacggggtaaccctaaacgggttaccgttaaaccgggtaaaaccttaaccggtaaaacccggttaccgttacgggttaccgggttaaccgtacggaacccttaacccgtacgttccgttacgtttacccttaaccttcccgtttaccccgttccccgtaccttaaccg

SEQ ID NO: 17276 - DNA, 756 bp, Homo sapiens
  misc_feature: GYAE6OF02IKVLD.44.34.D01.1.454.CMB.1.raw
tcagacagtatatacacgaccggtgctcgatttagatcgtctgtgttgggtttgggggcagaagtctctctcagtcgaggacacagcatggacatgacgggtccctgctcagctccgtggactcctgctgctcgtggctccagtatactgatgtcgacttccagatcgacccagtcctacacttccctccttcgtctagcctacgttcgtgggtagggactaccgaggtcgttaccactaactcctaccggttcgggccggacgtacgtacgacggcctaagtacgatactttaattcgacgtggtactacgacgacgaacaaccgaacggtaacctaccgttaacctccgtagtacttcgttacggtaccgtcgtaacttcgtaccctttagttccgaactacgtccggaaccgggttccctaacgtttcggttcccggtaagccggtccggtactagggttaacgtcggtacgtacgggtaactgttaacctttccgtctaccgtacctaacacgtacgtaccggctccgtaactcgacgtaccgtgtaccgaagtacggttgaaaccgttacgttaaacttcgttaaacgtacggtaactaaaaccggttacaacgtttaccggaccgttaccccgagtttacccctaaaccgggtttcccgggtaacccgggtaaaggttaaacccggttaaagggttaccgaaccgtttacgtaaaaccccgggtaaacccgttagttaacccgggtacgg

SEQ ID NO: 17277 - DNA, 891 bp, Homo sapiens
  misc_feature: GYAE6OF02FVZAE.44.34.D01.1.454.CMB.1.raw
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacatccagatgacccagtcctccatccctcctgtctgcatctggtgggagacgagtacgtccaccatccgtaacttcggccggggacgagtcgaggggacctaagttacggactaaagttttacgtttacgtcccgttagggttactaccgtagaccaaacggaaaaccgtaggggaaaacgtccgttaccgtaaacgtccgtttaccgtcgtacttacgttaactaacggtaaaacctacttacccgttaacttttttacggacctaaacttcccgggtaacgggggttacccctaacgtttcccgtttaacgggtttaccgaaggtacccgggtaccggtagggttacgggtacgttaccggggtacgggtaacgtaacggttacgtttttcccggttaccttaaccttcccgtaaacccgtaccgtaacccgttaacggaccgtaaccggtcccgtttaacgtacccggtaacggtaccccgttaaagggttaacgttaacgtttaccgggtttacgtaacccgtttaaaaccgttttttaacgttaaaccgttacgttaaaaccgtaaaaccgtttaaccgtaaccggtaccggtttacccgtacccccgtttaaccgtaacccgtttaaccccggttttacccgggtaccccggtttacccgggggtaaaaccgttaacggttaaccgggttaactttaaccgggttaaacccgtaaaacccgggtttaaccg

SEQ ID NO: 17278 - DNA, 840 bp, Homo sapiens
  misc_feature: GYAE6OF02HPFRQ.44.34.D01.1.454.CMB.1.raw
  modified_base (219)..(219): a, c, t, g, unknown or other
  misc_feature (219)..(219): n is a, c, g, or t
tcagacagtatatacacgaccggtgctcgatttagatcgtctgtgttgggtttgggggcagaagtctctctcagtcaggacacagcatggacatgacgggtccctgctcagctcctgggactcctgctgctctcggcctccagtatactaggatcgtagccttaccgagactcgacccagtcctccactccgtccctgtctgacacttctgggtagganacgtaggactaccaacctactccgtaacggttcgggccggggtacgacttaccggacggtaccctaagttaaggaaccttaagtttaagttaccgccggttaggttaacctcgaacggtaccgaaaaccggtaaaaccccgggaaaccgggtaaacccctttcccctaaaacccgttccgaggtttaactttccgtttcggacttcggacttaactccccttaaggtactaaccgtaaacgttccggggtaaacccggttccctaacgttcgggttttaccggaacggccggtacgggtaacccgtagggttaacggacggttccggtttaaacgggacttaaccggtttcttttacccgtaccgttaccaaccctaacgttacgtaaccgaaacggtcaaccggttccgtacggtacccgacggtacccgtaggtaaacgttcgtttacgtccgttaaacccgttaaagttacctttaaccggtaactaaaaaccgttaaaccgaaacttaaccgaacgtttccccacctaccgttaacgttacccgtaccccggtaccggtaacggaaccgtacggtaacttaaccgtaaagttaacccaaaggttacctggttaccgg

SEQ ID NO: 17279 - DNA, 772 bp, Homo sapiens
  misc_feature: GYAE6OF02H5ROZ.44.34.D01.1.454.CMB.1.raw
  modified_base (212)..(212): a, c, t, g, unknown or other
  misc_feature (212)..(212): n is a, c, g, or t
tcagacagtatatacacgaccggtgctcgatttagatcgtctgtgttgggtttgggggcagaagtctctctcagtcaggacacagcatggacagtgagggtccctgctcagctccgtgggactcctgctcgctctggctcccagactactagatgtcgacttcagatcgacccagtcctccatcctccctgtcctggcctatcgtggtgganactagcgtcacagtcacgttcggcggcgtagtcgacggaccattacgaacttaagtttaagttcgtccgtaggttaacttcgaacggacaaacggaaacccgtaaccgggtaaaccccttaccgttaaaccctaccgttgtaaccgtttcgttcgtcgtcgtacctacgtaccttacgttacgactaacgtccggaaccgggttccctaacgttacggtacccgttacgaacggtcgtaccggtagttaccggtacgtccggtacggggtaactaagttcccgtttacctccgttacgtacccgtaacgtctacgtacgtaccgtacgtaccgtaccgtaaccgtacgtacccggttaaagacgttaaacgttacgtttaaaccgtaacgttttaaccgtaacgttaaaggtaaaccgtaaaacgttaaccgtaaccgtacgttaccgttaaccccttacgttaaccgttacccggtacccggtaaccggttaccggtaaaccgtaagtttaccgtaaacttaccgtaacgtaaacccgttacgtacggaccgttaaccg

SEQ ID NO: 17280 - DNA, 719 bp, Homo sapiens
  misc_feature: GYAE6OF02F3O3R.44.34.D01.1.454.CMB.1.raw
  modified_base (153)..(153): a, c, t, g, unknown or other
  misc_feature (153)..(153): n is a, c, g, or t
  modified_base (233)..(233): a, c, t, g, unknown or other
  misc_feature (233)..(233): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctactggctccagatactagatgtnacttccgagatgacccagtctccatcctcctgtctgctatctggtcggaagtacagatccaccatcgacttcggaccggngaacgtcgacgggacctaagttacggactaaagttaagtttacgtcctagttaacgtctaacggcgaaacgaaaacccgtaacgggtaaacccctacccgtaacctaccgtaggtaacttacgtttgacgtcgactacgtacccttaaccgtttgaacctaacgtccgtaacggggttacccaagttccggttacggttacaaggttacccgggtacgtaaggtacgggtacgttaccgggtagggtaacgtagttaacgttttccgtaccgttaaccgtaccctaaaccgtacgttaccgaacgtaccgtaccggcccgttacgacgtaacccggtactaacggaaagttcttacggtttacaacggtttaaactttacgttaactaacgtaacgttaaaacgactaaacgtacgtaccaccgtactaccgtacgttaccgaccgtagtaaccgtaagtagataccgtaacaacgtacgagtacg

SEQ ID NO: 17281 - DNA, 792 bp, Homo sapiens
  misc_feature: GYAE6OF02JF4UA.44.34.D01.1.454.CMB.1.raw
  modified_base (105)..(105): a, c, t, g, unknown or other
  misc_feature (105)..(105): n is a, c, g, or t
  modified_base (111)..(111): a, c, t, g, unknown or other
  misc_feature (111)..(111): n is a, c, g, or t
  modified_base (128)..(128): a, c, t, g, unknown or other
  misc_feature (128)..(128): n is a, c, g, or t
  modified_base (189)..(189): a, c, t, g, unknown or other
  misc_feature (189)..(189): n is a, c, g, or t
  modified_base (659)..(659): a, c, t, g, unknown or other
  misc_feature (659)..(659): n is a, c, g, or t
  modified_base (670)..(670): a, c, t, g, unknown or other
  misc_feature (670)..(670): n is a, c, g, or t
tcagacagtatatacacgaccggtgctcgatttagatcgtctgtgttgggggttggggcagaagtctctctcagtcaggacacagcatggacatggacggtcccngctacngctcctggactcctgcngctctcggcctaccagactacgtagtactggtactacgttcagatcgtacccagtctaccnctccctcctgctgccgactcgtaggtgggacacgaggtactccaccgtatccgtagtccggaccgggactacggtagacggtacctaagttacgtattattaacgttacgccgtaggtaactacggaacttaccggaaaagaaaccccggtaacgggtaccccctaaaccgttacccctacgttacggtacctttaccgttagggtaccttaccggtacctaccgttaccctacgtttacgggaacctttacgaccgggttacccggtacttaccttacgggtttaccgacgtaacggtcggtaaccttcgggacccgttaacgttacgggtaccgtacgtttaaccggttaccttacgttaccgtactaccgtaccgtaatccgacggttaccgacggtccttacggtacctaacggtcgtagtaacgttcggtactaacgttaacgtacttacgtcgtaaacccgtanaaccgttaaanaccgtacgtacccgtacccgtagttaacccggttacggtcccggttaacccggtaacggtaccgtaaaacggtaccgttacgtaaacccggttaacgttaacccgttaaggccgttaaccgg

SEQ ID NO: 17282 - DNA, 781 bp, Homo sapiens
  misc_feature: GYAE6OF02I87B4.44.34.D01.1.454.CMB.1.raw
  modified_base (149)..(149): a, c, t, g, unknown or other
  misc_feature (149)..(149): n is a, c, g, or t
  modified_base (152)..(152): a, c, t, g, unknown or other
  misc_feature (152)..(152): n is a, c, g, or t
tcagacagtatatacacgaccggtgctcgatttagatcgtctgtgttggggtttgggggcagaagtctctctcagtcaggacacagcatggacatgagggtccctgctcagctcctgggactcctgctgctctggctccagtatactanatntgaccttccagtatcgaccagtcctccatccctcctgtctgactactctggtagggaacgtacagtagtaccaacctactctacgttcggaccgggagtacgtacgacggtacctagttacgactaatttacttacgtacgtaggttaactacgaacgtaacgtaaacgtaaaccgaaccggtaaaccccgtacccttaaccccgtccgtaacgtaactttaccgttacgtaccgtacgtaccgtaaccttaccgttacgtttaccgaacttaacgtacccggtaaccggggttaccctacgttcgttaccggtacgacggtaccggtacgtaggttaccggtaggtaccggtacggtacgtacgtttaaccgtttccgtacttacccgtaacctaccgtaacgttactaccggttaaccgaccgttacgttaccgacccgttaacgtaccggttaacgtaaacgttacgttaaaccgttttaaccttaaactttaccgttaaccgttaacggtaaaccttaacgtaacgtaccgttaacgtccgtaaccctcgtaccgttaccgtaccggaccgtacggtaacacggtagtaacgtaacgtaaccgtacgtacgttaggtcctaaccg

SEQ ID NO: 17283 - DNA, 328 bp, Homo sapiens
  misc_feature: GYAE6OF01DEHKZ.8.4.A04.1.454.CMB.1.raw
  modified_base (322)..(328): a, c, t, g, unknown or other
  misc_feature (322)..(328): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccagctgaccgtcctaggtcagcccaaggctgccccctggtcactctgtcccgcctcctcgacacgcgagctgagcggctggcaaggcgcatagnnnnnnn

SEQ ID NO: 17284 - DNA, 331 bp, Homo sapiens
  misc_feature: GYAE6OF01AY256.8.4.A04.1.454.CMB.1.raw
  modified_base (327)..(331): a, c, t, g, unknown or other
  misc_feature (327)..(331): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccaagctgaccgtctaggtcagcccaaggctcgccccctggtcactctcgttccccgccctcctcgacacgcgagctgagcggctggcaaggcgcatagnnnnn

SEQ ID NO: 17285 - DNA, 333 bp, Homo sapiens
  misc_feature: GYAE6OF01EUYRN.8.4.A04.1.454.CMB.1.raw
  modified_base (326)..(333): a, c, t, g, unknown or other
  misc_feature (326)..(333): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccaagctgaccgtcctaggtcagcccaaggctgccccctggtcactctgttcccaccctcctcgacacgcgagctgagcgggctggcaaggcgcatagnnnnnnnn

SEQ ID NO: 17286 - DNA, 335 bp, Homo sapiens
  misc_feature: GYAE6OF01EM7PN.8.4.A04.1.454.CMB.1.raw
  modified_base (326)..(335): a, c, t, g, unknown or other
  misc_feature (326)..(335): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccaagctgaccgtcctaggtcagcccaaggctgccccctggtcactctgttcccaccctcctcgacacgcgagctgagcgggctggcaaggcgcatagnnnnnnnnnn

SEQ ID NO: 17287 - DNA, 344 bp, Homo sapiens
  misc_feature: GYAE6OF01AD197.8.4.A04.1.454.CMB.1.raw
  modified_base (210)..(210): a, c, t, g, unknown or other
  misc_feature (210)..(210): n is a, c, g, or t
  modified_base (333)..(344): a, c, t, g, unknown or other
  misc_feature (333)..(344): n is a, c, g, or t
tcagctcgcgtgtccacgaccggtgctcgatttagagtagtgatcaggctccacgcatgctcatgtacagcacaaacattcgcacttctgggtccctgatcgcttctctggctccatccttgggaacaagctgccctcaccatcacgggggcccaggcagatgatgaatctcattattactgtgcactgctatttgcgtgatgtcaattngtgttcggcggagtaccaagctgaccgtctaggtcagcccaaggctcgccccctggcacctctcgttccccaccctcctcgacctccgcgacgctggaggccgggctggccaaggcgcatggnnnnnnnnnnnn

SEQ ID NO: 17288 - DNA, 533 bp, Homo sapiens
  misc_feature: GYAE6OF01BRY2T.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggccaggctccacgcatgctcatgtacagcaacaaacattcgcacttctcggggtccctgactcgcttctctggctccatccttaggaacaagctcgccctcaccatccgaccggggcccaggcagatgatagaactctactaatttacttactgtcgctactgctagtttgtcgttgtattgttactaagtttagtggttacggttcgggcgggacgggtaaccg

SEQ ID NO: 17289 - DNA, 335 bp, Homo sapiens
  misc_feature: GYAE6OF01EEJZO.8.4.A04.1.454.CMB.1.raw
  modified_base (328)..(335): a, c, t, g, unknown or other
  misc_feature (328)..(335): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccaaggctgccccctggtcactctcgttcccaccctcctcgacacgcgagctgagcgggctggcaaggcgcatagnnnnnnnn

SEQ ID NO: 17290 - DNA, 548 bp, Homo sapiens
  misc_feature: GYAE6OF01B3KJB.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggccaggctccacgcatgctcatgtacagcaacaaactattccgctacttcgtcggggtccctgactcgtcttctcgtcggtctccacttccgttaggaacaaagctccgccctccaccacgtccggaccggggcccaggcagatgatagactctactattattactgtcgctactcgtctagtttcgcgttgtgttgtacttaagttagttaggttggttcgggcgggaacgggtaaccg

SEQ ID NO: 17291 - DNA, 624 bp, Homo sapiens
  misc_feature: GYAE6OF01ESSWN.8.4.A04.1.454.CMB.1.raw
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccgtggagagacagtcacactcacttgtggcttgagctctggctcagtctctcgtcggttacctcccccttnttcggtaccagcacgaccccgaggccacggcctccacgcatcgctcatcgtacagacaacaaacnttcgctacgttcgtcggtcctgactcgtcttcgtcgtcgcctcctacttccgttagggaaacctaagtcctcgacccttaccacctacgtcccggaccggggcccagggccaggtactaggaacttagaacgttctacttaatttaacttacgtgttcgacctacgttcgtacttacggtttcgtaccggtagttacttacggtttaactaaagttttacggttacgggttacgggtttaccgggggccgggtaaacgggtaaccccgg

SEQ ID NO: 17292 - DNA, 339 bp, Homo sapiens
  misc_feature: GYAE6OF01BQJ1G.8.4.A04.1.454.CMB.1.raw
  modified_base (213)..(213): a, c, t, g, unknown or other
  misc_feature (213)..(213): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (331)..(339): a, c, t, g, unknown or other
  misc_feature (331)..(339): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcgacgggggcccaggcagatgatgaatctcattattactgtgcactgctatttgcgtgatgtcaattntgtgttcggcggaggaccagctgaccgtctaggtcagcccaaggctcgcccctggtcnctctcgttccccnccctcctcgaccacgcgagctgacggcgggctggcaaggcncatagnnnnnnnnn

SEQ ID NO: 17293 - DNA, 573 bp, Homo sapiens
  misc_feature: GYAE6OF01A8C7X.8.4.A04.1.454.CMB.1.raw
  modified_base (231)..(231): a, c, t, g, unknown or other
  misc_feature (231)..(231): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (508)..(508): a, c, t, g, unknown or other
  misc_feature (508)..(508): n is a, c, g, or t
  modified_base (558)..(558): a, c, t, g, unknown or other
  misc_feature (558)..(558): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacngtcacactcacttgtgcttgagctctggctcagtctctcgtgttacctcccctcttgtaccngcacgacccnggccaggctccacgcatcgctcatgtacacgacaacaaacattccgctacgttcgtcgggtccctggtactccgtcttcctcgtcgtcctcctacttccgttaggaaactaacgtcctaccgccctaccacctacgtacccgggacccggggacccaggaccagactgaagtagtaacttcgtacttagtttataccgtgtaccntactgtacttagttgcgttgattagtataagtttagtggttaggtcgggngggtacgggtaaccg

SEQ ID NO: 17294 - DNA, 336 bp, Homo sapiens
  misc_feature: GYAE6OF01BSM0R.8.4.A04.1.454.CMB.1.raw
  modified_base (324)..(336): a, c, t, g, unknown or other
  misc_feature (324)..(336): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgctatttgcgtgatgtcaattatgtgtcggcggaggacagctgaccgtctaggcagcccaaggctcgcccctggtcactctcgtcccgccctcctcgacacgcagcctggacgcggctggcaaggcgcagtagnnnnnnnnnnnnn

SEQ ID NO: 17295 - DNA, 562 bp, Homo sapiens
  misc_feature: GYAE6OF01CH2UH.8.4.A04.1.454.CMB.1.raw
  modified_base (358)..(358): a, c, t, g, unknown or other
  misc_feature (358)..(358): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccagggagccgtcgttcctccgtcgtcccctggagagacagtcacactcacttgtggcttgagctctggctcagtctctcgtgttacctccccctcttgtaccagccacgaccccaggccacggcctccgacgcagtcgcctcatcgtacacgaccaacaaactnttccgctacgttcgtcgggtccctgactcgtccttctcgtgctccattccgtaggaacaacgctcgaccctcaccacgtcggaccggggcccaggcgagatgatgtactcttactatttacttactgtacnctacgtcgtacttagtttcgngttagtnttagtacttaagttgttacggttggttacgggcggtagggaaccg

SEQ ID NO: 17296 - DNA, 581 bp, Homo sapiens
  misc_feature: GYAE6OF01BDD4Q.8.4.A04.1.454.CMB.1.raw
  modified_base (530)..(530): a, c, t, g, unknown or other
  misc_feature (530)..(530): n is a, c, g, or t
  modified_base (541)..(581): a, c, t, g, unknown or other
  misc_feature (541)..(581): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaagctgccctcaccatccgacgggggcccaggcagatgatgaatctctattattactgtgcactgctatttgcgtgatgtactaatttagtggttcggttccggggacgggaacggggtaacccgaaaggtccctacggtaacccccggttccttaacggggtacccaacggaccccccgaaaaggggtccccttacccggccccccccccgtttacggggtacccctaacccgttttcccgttcccgggttttcccccccccgcccccccgtttccccggttacccggaaccccctaacccggggcccgggtaacggtccccgttacggggaacccggggtcccggggggtacccgttacggggacccgtaaaacggggggccgaaccggtaattacgggntcgcacgcagnnnnnnnnnnnnnnnnnnnnnnnnnnnnnnnnnnnnnnnnn

SEQ ID NO: 17297 - DNA, 867 bp, Homo sapiens
  misc_feature: GYAE6OF01CIMNZ.8.4.A04.1.454.CMB.1.raw
tcagctcgcgtgtccacgaccggtgctcgatttagagtagtgatcagggggaaaggccctgaggaaaacaaaccccagctgggaagcctgagaacacttagccttcatgagtgtccccaccatggcctggatgatgcttctcctcggacttccttgcttatggatcaggagtggattctgagactgtggtgacccgaggacgtccgttcgttctccgtcgtccctggacgagacagtcacactctacgttgtggcttggacgtctccgtcggactcgcggtcttcgttcgttcggtttaccctccccttcgttacggtaccacgccgaaccgaccccgaggaccgacggtccctaccgaccgctacgtcgtacctacgtacgtacgtaaccacgtaacaaacctaaaaacttccgttaccggtaccttaaccggtttcccgggtacggggttaccccttagtaccggtttccgttccgttttccgtaccggtccggttacccgttacccgtttaaccggtttacccggttaaacggggtaaaacctaaccgggttaccccttcccgggtacccccttaacccgaaccccgtttaccgggtaccccggggaacccgggggtacccccgtaaggacccgtaagtaacggttacggtaactaacggttaccctaccgtttaagttaaccttttaacggtttacctacgggtactaacccggttaaccgttcggtttaaccttaacgggttttcgtaacccgggttttgttaaacccgtttacgggttaaacttttaaacggtttagggtttaaccgggttttacccgggggtaacggggttaaccgggggaaacccgggttaaacccggg

SEQ ID NO: 17298 - DNA, 656 bp, Homo sapiens
  misc_feature: GYAE6OF01BBEF9.8.4.A04.1.454.CMB.1.raw
  modified_base (610)..(610): a, c, t, g, unknown or other
  misc_feature (610)..(610): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggatttctgagactggtggtcgaccccgagggacgcccgtcgttcctccgtcgtccccctggagagacagtcacactcacttgtggcttgagctcgtggcctcacgttcctcgtccggttcggtttacccttccccccttcgtttcgggtacccacgccaaccggacccccacgggcccacggccctacccgacgtcatcgcctcattcgtaaccagaccaaccaaactacttccgacctaccgtttcggtcgggtccctacgtacgtccgtccttctctcggcccttacctaccgttccgttaacgggaaactaaacgcctccgacccctccacctacggtacccggaacccggggccccaggaccgagaacgtagacgtagtaactccttacttatttacttacgtgtcgactacttgaccttgttacgtgttatntactcttaaacgttgttcggttaggtccgggagggaccgtaaccgg

SEQ ID NO: 17299 - DNA, 683 bp, Homo sapiens
  misc_feature: GYAE6OF01CM0S3.8.4.A04.1.454.CMB.1.raw
  modified_base (607)..(607): a, c, t, g, unknown or other
  misc_feature (607)..(607): n is a, c, g, or t
tcagctcgcgtgtccacgaccggtgctcgatttagagtagtgatcagggggaaaaggccctgaggaaaacaaacccagctgggaagcctgagaacacttagccttcatgagtgtccccaccatggcctggatgatgcttctcctcggactccttgcttatggatcgaggagtggattcgtgagactggtggtcgacccgagggacgtccgtcgttcctccggtcgtccccgtggagagacacgtcacactctacgttggtcgtcttgacgtctcgtggctcagtctcgttcggttcggttaccctccccttcgttcggacctacgacgaccgacccgaggccgacggcctccacgcagtcgctcatcgtacacgacaacaaactctcgactacgttccggtcggtcctcgtactccgtcttccgtacgtcgtacccttccgtacgttaccggttaacggaaactaacgtccgtaccgtacccctacaacccgtacgtaccgggacccgggacccaggacgtaagacgtacgtaacgtacgtaacttacctacgttaattttacgttacgtgttccgacttaaccgttgtaaccgttagttttacggngttaacgttgttacgttaagtttaacgtttacggttcgggtttacgggtcccgggaaggggttaacccgggtaacg

SEQ ID NO: 17300 - DNA, 714 bp, Homo sapiens
  misc_feature: GYAE6OF01ATKHF.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtcgacccaggacgccgtcgttccgtccgtcgtcccctgggagagacagtcacactcacttgtggcttgagtctcgtggctcacgtctcgttcgttcggtttacctccccctgttcggtaccagccacgaccccaggccaggcctccacgcatgctacatcgtacagccaaacaaactattcgactacgttcggtcggtccctagacttccgtctttcctcgtgcctcgtaactccggttagggaaactaacggtcctacccgtaccctaccctaacctaccggtaccggaaccccgggggtccccaacgggaccgtacggtaagtaccgttaaagtacggtaaaccttccttaacgttaagtttttaacgtttaacgttcgtaccgtacccgaacgttcggtaaccttaagggttttcgtaccggttacggttaaaccgtttcggttaaactttaaccggttttaggttaccgggtttacggggttaaccccgggggtaggggtaaaccccggggttaaacccgg

SEQ ID NO: 17301 - DNA, 333 bp, Homo sapiens
  misc_feature: GYAE6OF02GEHBN.8.4.A04.1.454.CMB.1.raw
  modified_base (327)..(333): a, c, t, g, unknown or other
  misc_feature (327)..(333): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccaaggctgccccctggtcactctgttcccaccctcctcgacacgcgagctgagcgggctggcaaggcgcatagnnnnnnn

SEQ ID NO: 17302 - DNA, 496 bp, Homo sapiens
  misc_feature: GYAE6OF02HSQVN.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttggaacaagctgccctcaccatcacggggcccaggcagatgatgaatctacattattactgtgcactgctagtttgcgtgatgtacaattatgtgttcggcggaggaaccg

SEQ ID NO: 17303 - DNA, 512 bp, Homo sapiens
  misc_feature: GYAE6OF02GP6YR.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggcccaggcctccacgcatgctcatgtacagcacaaacattcgcacttctggggtccctgatcgcttctctggctccatcctaggaacaagctcgccctcaccatcgaccggggcccaggcagatgatgaatctacatttattactgtcgcactgctagtttgcgtgtatgtactaattagttgttggttcggacgggaggtaaccg

SEQ ID NO: 17304 - DNA, 524 bp, Homo sapiens
  misc_feature: GYAE6OF02H3C0Q.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggccaggcctccacgcatgctcatgtacagcacaaacattcgctacttcgtcggggtccctgactcgcttctctgctccactccttaggaacaagctcgccctcaccatccgaccggggcccaggcagatgatagaatctctattattactgtgctactgctagtttgcgtgtattgtactaatttagttggttcggttcgggcgggagggtaaccg

SEQ ID NO: 17305 - DNA, 551 bp, Homo sapiens
  misc_feature: GYAE6OF02FXS5Q.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggccaggcctccacgcatgctcatgtacagcaacaaacattcgctacgttcgtcggggtccctgactcgtcctttctctggcctcctacttcccgttagggaaacaacgcctcgcccctcaccacgtccggaccggggcccagggcagatagatgtaactctactatttacttactgtgctactgctagttggacttgtattgttactaattcgtggttcggttcgggtacgggtaggtaaccg

SEQ ID NO: 17306 - DNA, 657 bp, Homo sapiens
  misc_feature: GYAE6OF02HHTUA.8.4.A04.1.454.CMB.1.raw
  modified_base (302)..(302): a, c, t, g, unknown or other
  misc_feature (302)..(302): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtcgacccaggagccgtcgttcctccgtcgtcccctggagagacagtcacactcacttgtggcttgagtctctgctcagtcctctcgttcgttacctccccctgttcggtaccngccacgaccccgcggcctacggcctccacgcatcgctctatcgtacacgacaacaaactacttacgctaccgttcgtcgggtccctgactcgtcttcgtctcggcctacctctccgttaagggaaactaacggtcacgtcccctactaccctaaccgtccgggacccggggtcccgagggaccgacgtagtcggtaacgttacgtaacttcgttaacctaagttttacgttaaccgttcggtactaccttacgtacgttacgtttacgtttcgggacgtttagtacgttacgtttaaccgtaagttttacggtcgggttttaccgggtaccgggtacggggtaacggtaacccgg

SEQ ID NO: 17307 - DNA, 568 bp, Homo sapiens
  misc_feature: GYAE6OF02IXJWC.8.4.A04.1.454.CMB.1.raw
  modified_base (286)..(286): a, c, t, g, unknown or other
  misc_feature (286)..(286): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtgcttgagctctgctcagtctctcgtcgttacctccccctnttcgtaccagcacgacccaggccaggcctccacgcatcgctcatgtacacgacaacaaactacttcgactacttcgtcgggtccctagtctccgtcttcctcgtcgtcctaccgtacgttccgttaggaaacctaagtcctacgccctacaccctacgtaccgggaccggggcccaggacagactgacgtgaactctactattagttctgtcncgtactcgtntagttcgtcgttagtcgttagtacttaagttcgttggtcggtacgggacggacggtacg

SEQ ID NO: 17308 - DNA, 536 bp, Homo sapiens
  misc_feature: GYAE6OF02FRII3.8.4.A04.1.454.CMB.1.raw
  modified_base (287)..(287): a, c, t, g, unknown or other
  misc_feature (287)..(287): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtccccctggagagacagtcacactcacttgtggcttgagctctggctcagtctctcgtggttactccccctnttcggtaccagcagaccccaggccaggctccacgcatgctcatgtacagcacaaacattcgcacttctcggggtccctgatcgtcttctctggcctcacttccgttagggaaactaaagcctcgcccctcacccatcgaccggggcccagggcagatgatgaactctactatttattactgtcgctaacgtgactagtttgcgttcgattcgtactaattgttggttcggttcggacgggaggtaaccg

SEQ ID NO: 17309 - DNA, 403 bp, Homo sapiens
  misc_feature: GYAE6OF02GFFP8.8.4.A04.1.454.CMB.1.raw
  modified_base (373)..(373): a, c, t, g, unknown or other
  misc_feature (373)..(373): n is a, c, g, or t
  modified_base (376)..(403): a, c, t, g, unknown or other
  misc_feature (376)..(403): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccttgggaacaaagctgccctcaccatcgacgggggcccaggcagatgatgaatctcatttattactgtgcactgcatttgcgtgattgtactaatttatggttggttcgggcgggtaggaccagctgacccgtctaggtcagacccgaaggcctccgtccccctccggtccaccgttctccgttccccaccctccctccgaccaccgcgacgcgtaggacggtcggggtcctgggacgaacggcgacgagtagncgnnnnnnnnnnnnnnnnnnnnnnnnnnnn

SEQ ID NO: 17310 - DNA, 810 bp, Homo sapiens
  misc_feature: GYAE6OF02GYZUG.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggtattctgagactggtggtcgacccgaggacgtccgtcgttctccgtcgtccctaggagagacagtccactacctctacgttggtggcttgacgtcttcgtcgctcgacttccgttcgtcgttcggttaccccttccccttagttacggtaccacgcccaaccggaaccccgacggtaccacgggtcctacccgacgcacgttcgctactacgtcgtaaccgacaaccgtaaactaaaacgtccgttaccgtaccgttaaccggtttccggggttacccggggttacccctaggttacccgttacccggttacccgttttaccgtacccggttccgggtaacccttaaccccgtttaacggtttaaccccgggttttaaacggggaaaaacctaaaccgggttccttaacccggtacccctaccggaaaccgtaccggttacccggggaaccccggggtaaccgcggaacgtaggtactacggtacttaacggtaccttacgttaacttacgttttaactcggtcgttaccggaactttacgtcgttaacgtttacgttcggtaacttaggtacgtttaccgtaagttaacgtttggtaccggggtttaccggtaacgggaccggtaacgggtaacg

SEQ ID NO: 17311 - DNA, 748 bp, Homo sapiens
  misc_feature: GYAE6OF02F8GD7.8.4.A04.1.454.CMB.1.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtgacccgaggacgtccgtcgttctccggtcgtccccgtggagacgacacgtcacactcacttggtgtcttgacgtctcgtggtacctctacgtccttcgttcggtaccggtttaccctccccccttcgttacggacctacggcctaaccgaccccgtacggacccgacggtaccctccgaacgcgtacttcggctacgtaagtacggtaaccacgtaccaaacctaaactccgttaccgtaccgtaaccgtttccgggttccggggttacccctggtaacctttccggttcctttacctcggtccgtaccgttcccgtaccgtttacccggtaacgggaaaccgtaaacggtccgtacccgtcccgtaccgacccgtaccggtacccggggtacccggggccgacggtacaaggtcgtagtacgtacggttaactccgtttacgttaactttacgttacgttagaccgtacgtacgtgtaccgtttagttacggtccgtagtacgttacgttacgttactttggtacggttaccgggacggggacggtaacggtacgg

SEQ ID NO: 17312 - DNA, 810 bp, Homo sapiens
  misc_feature: GYAE6OF02F8OR7.8.4.A04.1.454.CMB.1.raw
  modified_base (271)..(271): a, c, t, g, unknown or other
  misc_feature (271)..(271): n is a, c, g, or t
  modified_base (710)..(710): a, c, t, g, unknown or other
  misc_feature (710)..(710): n is a, c, g, or t
tcagctcgcgtgtccacgaccggtgctcgatttagagtagtgatcagggggaaagccctgaggaaaacaaaccccagctgggaagcctgagaacacttaagccttcatgagtcgtccccacatggcctggatgatgccttctcctcggaccttccttgcttagtggatcgaggagtggattctgagacgtgtggtacgacccgaggcgccgttcgttctaccgtcgtcccgtgggacgacgtacgacgtcacctaactcctaagtttcggnggtaccgtttaggacttccgtccggttcggtccttacgtcggtttccttaccggtttacggttacccggtttacccccttaccccccgtttaggttttaacccggaaccgtacgttaccaaaccccgggacccccgacggggtacccgtaccggtcccgttacccggaacggtcctaacgtccggtccttaccgtaaggttaccgaacggaacgtaaccaaaccgttaaacgtcgttcccgacgttaccgttaccggggttcggtaccctagtaccttccgtccgttcgttacggtccgcctacgttaccgtaccggttaaggtaaacctaccgtcccgtaccgtccctaacccgtacgtaccggaccgggaccccgggtaacggtacgacgtacgaacgtacgtaataacgtcgtccttaagttactttacggttacncggtaacgtctacggtattacggtcttggtacgttagtaccgttattacgttaacgtttcggttacggtaccgggttcgggtacggtaacggttaaccgg

SEQ ID NO: 17313 - DNA, 724 bp, Homo sapiens
  misc_feature: GYAE6OF02JK2Z9.8.4.A04.1.454.CMB.1.raw
  modified_base (609)..(609): a, c, t, g, unknown or other
  misc_feature (609)..(609): n is a, c, g, or t
  modified_base (649)..(649): a, c, t, g, unknown or other
  misc_feature (649)..(649): n is a, c, g, or t
tcagctcgcgtgtccacgaccggtgctcgatttagagtagtgatcaggggggaaaaggccctgaggaaaaacaaaccccagctgggaagcctgagaacacttagccttcatgagtcgtccccaccactggcctggatgatgcttctcctcggactccttgcttatggatcgaggagtggattctggacgactggtggtcgaccgaggacgccgttcgttccttccggtcgtcccgtggagacgactagtccacactacctacttggtcggtcttggacgtcgtcgtcggtcctcgtacgttccttccgttcggttccgggtttaccccttcccccgttcgttaccggtacccgacggaccgtaccggacccccgacgggtacccgacgggtccctacccgacgcctaacgtcgccttacgtactacgtaaccaacggaaccaaacgtaaacctacgttacccggtacttaaccgtttcgggttaccgggttacccttaggtaccgttccggtcctttaccgtcggtccggtccctccgtaacttccgggtaaacggaactaacgtcctccgtacctccaaccgtcgaccgggaccgggaccagctacgngtcgaacgacgtactcgtacttattaactgtcgcacgtcngttactacgtcggtacgtacgtacgttacgttaattacggtttagtcgggttacgggtcggtacggacgtaaccg

SEQ ID NO: 17314 - DNA, 753 bp, Homo sapiens
  misc_feature: GYAE6OF02H6ZN1.8.4.A04.1.454.CMB.1.raw
  modified_base (177)..(177): a, c, t, g, unknown or other
  misc_feature (177)..(177): n is a, c, g, or t
  modified_base (519)..(519): a, c, t, g, unknown or other
  misc_feature (519)..(519): n is a, c, g, or t
  modified_base (550)..(550): a, c, t, g, unknown or other
  misc_feature (550)..(550): n is a, c, g, or t
tcagctcgcgtgtccacgaccggtgctcgatttagagtagtgatcaggctccacgcatgctcatgtacagcacaaacattcgcacttctggggtccctgatcgcttctctggctccatccgttagggaacaaagcgtgccctcaccgatcgaccgggggccaggcagatgatgaatntacagtttattactgtgccacgtgactagtttcggccgttagatgttacaacgtttagtcggttcggttacggacgggtaagggacctaacggtcctacggtacccggttacgtacggtccgaacgtaccccgagggtaccctccggtaccccccgtcggtacctaactttcccgtaccgttcccccgtacccgttccgtaacccggaacgtcccgggtacggtacggtccccgttaggggtacccggggtaccggggtcccgttaacggggtaccggtaaacggggcccgtaacgtaaacggtgttaacgccgtaacgagtttacgacggactccgtaacnccggtatccggaatccgtcgtaaaacggtcnccggttaaacggaccttgggaaccttggtaaccgtggtacgtaacctttggggtaaactacgtaacgtaccgtaccgtacgtacgtacgtacggtaccggtacggtacggtacgtacgtacggcgtacgtacggtagtacggtacgtacgtacgacgtaaccgtacggtaacgtccgtacgtacgtagtaccgtactacgacg

SEQ ID NO: 17315 - DNA, 415 bp, Homo sapiens
  misc_feature: GYAE6OF01B5NOX.34.33.C11.1.454.CMB.1.raw
  modified_base (410)..(415): a, c, t, g, unknown or other
  misc_feature (410)..(415): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcacgtcctaggtcagcccaaggccaaccccactgtcactctgttcccgccctctcatcacgtgtactgagcgggctggcaaggcgcatagnnnnnn

SEQ ID NO: 17316 - DNA, 426 bp, Homo sapiens
  misc_feature: GYAE6OF01AR260.34.33.C11.1.454.CMB.1.raw
  modified_base (420)..(426): a, c, t, g, unknown or other
  misc_feature (420)..(426): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcaccgtctaggtcagcccaaggccaaccccatgtcactctcgttccccaccctcctcatcacgtgtactgagcggctggcaaggcgcatagnnnnnnn

SEQ ID NO: 17317 - DNA, 428 bp, Homo sapiens
  misc_feature: GYAE6OF01BOHSC.34.33.C11.1.454.CMB.1.raw
  modified_base (417)..(417): a, c, t, g, unknown or other
  misc_feature (417)..(417): n is a, c, g, or t
  modified_base (422)..(428): a, c, t, g, unknown or other
  misc_feature (422)..(428): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatgtctcctatgtcttcggaactgggaccaaggtcacgtcctaggtcagcccaaggcccaaccccactgtcactctcgttcccaccctcctcatcacgtgtactgagcgggctggcaaggcgnatagnnnnnnn

SEQ ID NO: 17318 - DNA, 425 bp, Homo sapiens
  misc_feature: GYAE6OF01EKEP0.34.33.C11.1.454.CMB.1.raw
  modified_base (358)..(358): a, c, t, g, unknown or other
  misc_feature (358)..(358): n is a, c, g, or t
  modified_base (418)..(425): a, c, t, g, unknown or other
  misc_feature (418)..(425): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggacaaggtcacgtcctaggtcagcccaaggcccaacccnctgtcactctgttcccacctcctcatcacgtgtactgagcgggctggcaaggcgcatagnnnnnnnn

SEQ ID NO: 17319 - DNA, 414 bp, Homo sapiens
  misc_feature: GYAE6OF01EQKDQ.34.33.C11.1.454.CMB.1.raw
  modified_base (410)..(414): a, c, t, g, unknown or other
  misc_feature (410)..(414): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggacaaaggtcaccgtctaggtcagcccaaggccaacccactgtcactctgttcccaccctcctcatcacgtgtactgagcggctggcaaggcgcatagnnnnn

SEQ ID NO: 17320 - DNA, 450 bp, Homo sapiens
  misc_feature: GYAE6OF01DCNHN.34.33.C11.1.454.CMB.1.raw
  modified_base (438)..(438): a, c, t, g, unknown or other
  misc_feature (438)..(438): n is a, c, g, or t
  modified_base (443)..(450): a, c, t, g, unknown or other
  misc_feature (443)..(450): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcacgtctaggtcacgcccaaggccaacccactgtcactcctcgttcccaccctcctacactccacgtgtactgacggtcggctggacaaggcgnatagnnnnnnnn

SEQ ID NO: 17321 - DNA, 495 bp, Homo sapiens
  misc_feature: GYAE6OF01D5HR9.34.33.C11.1.454.CMB.1.raw
  modified_base (208)..(208): a, c, t, g, unknown or other
  misc_feature (208)..(208): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctgggacccccgggnagagggtcaccatctcttgttctggaagcagctccaacatcggaagtaatactgtaaactggttcagcaactcccaggaacgccccaaactcctcatccatagtaataatcagcggccctcgacgggtccctgaccgattctctgctcaagtctggcacctcacgcctccctggccatcagtggctccggtctgaggatgagctgactattactgtgcagcagtgggatgacagctgaatggctctatcgtctggactgggaccaaggtccacgtcagtcagacccg

SEQ ID NO: 17322 - DNA, 418 bp, Homo sapiens
  misc_feature: GYAE6OF01C5KOF.34.33.C11.1.454.CMB.1.raw
  modified_base (413)..(418): a, c, t, g, unknown or other
  misc_feature (413)..(418): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcaccgtctaggtcagcccaaggccaaccccatgtcactctcgttccccgccctctcatcacgtgtactgagcgggctgggacaaggcgcatagnnnnnn

SEQ ID NO: 17323 - DNA, 427 bp, Homo sapiens
  misc_feature: GYAE6OF01CIUXQ.34.33.C11.1.454.CMB.1.raw
  modified_base (420)..(427): a, c, t, g, unknown or other
  misc_feature (420)..(427): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggagggaccaagctgaccgtctaggtcagcccaaggctcgcccctcggtcactctcgttcccaccctcctcatcacgtgtactgacgcgggctgggcaaggcgcatagnnnnnnnn

SEQ ID NO: 17324 - DNA, 253 bp, Homo sapiens
  misc_feature: GYAE6OF01EVENB.34.33.C11.1.454.CMB.1.raw
  modified_base (200)..(253): a, c, t, g, unknown or other
  misc_feature (200)..(253): n is a, c, g, or t
tcagtacacgtgatcacgaccggtgctcgatttagagtgagctcgttgggtttgggtcagcctccaccaagggcccatcggtcttccccctggcacccctcctccaagagcacctcctggggggcacagcggcccctgggcctgcctggtcaaggctacttccatcacgtgtactgagcgggctggcaaggcgccatagnnnnnnnnnnnnnnnnnnnnnnnnnnnnnnnnnnnnnnnnnnnnnnnnnnnnnn

SEQ ID NO: 17325 - DNA, 418 bp, Homo sapiens
  misc_feature: GYAE6OF01CH9E6.34.33.C11.1.454.CMB.1.raw
  modified_base (411)..(418): a, c, t, g, unknown or other
  misc_feature (411)..(418): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggacattattggactccagcctgaggatgaggctgattattactgtcagtcacatgacaacaccctgggcggggtcttcggcggaggaccaagctgaccgtcctcagtcagcccaaggctcgccccctcggtccactcctgttccccaccctcctcactcacgtgtactgacgcggctggcaaggcgcatagnnnnnnnn

SEQ ID NO: 17326 - DNA, 417 bp, Homo sapiens
  misc_feature: GYAE6OF01DQBFD.34.33.C11.1.454.CMB.1.raw
  modified_base (410)..(417): a, c, t, g, unknown or other
  misc_feature (410)..(417): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctctatgtcttcggactgggacaggtcaccgtctaggtcacgccaaggccaacccactgtcactctcgttcccgccctcctcatcacgtgtactgagcgggctgggacaaggcgcatagnnnnnnnn

SEQ ID NO: 17327 - DNA, 655 bp, Homo sapiens
  misc_feature: GYAE6OF01BPI4G.34.33.C11.1.454.CMB.1.raw
  modified_base (210)..(210): a, c, t, g, unknown or other
  misc_feature (210)..(210): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagcccaccctcagcgtctcggggacccccggnagagggtcaccatctcttgttctggaagcagctaccaacatcggaagtaatactagtaaacttggttcagcaactccgaggaaccgccccaaactcctcactccatagtaatatcagcgccctcgacgggtccctgaccgtattctcgtcggctaccgaagtctcggcctacctcacgccctcccgtggccctagtcacgggtcgggtcccgttcccggtctgggaacggtatcgggacggtccttacgtactttagtttacgttggtcgcacggtcctaggtggggtaattcggaaccgtacggtcccttaaggtaacgttcgggtacccttacccgttagttccggttaccgtttaccgggaaaccgttacgggggaaacccctaacgggttccctaaccccggtttaccggttaacgggtcccgaaccgggtaaccccccgg

SEQ ID NO: 17328 - DNA, 435 bp, Homo sapiens
  misc_feature: GYAE6OF01DL7L0.34.33.C11.1.454.CMB.1.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (410)..(411): a, c, t, g, unknown or other
  misc_feature (410)..(411): n is a, c, g, or t
  modified_base (422)..(422): a, c, t, g, unknown or other
  misc_feature (422)..(422): n is a, c, g, or t
  modified_base (427)..(435): a, c, t, g, unknown or other
  misc_feature (427)..(435): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactccaggaaccggcccccaaactcctcatccatagtaataatcagcggccctcgaggggtccctgaccgattctctggctccaagtctggcacctcagccctccctggccatcaggtgggctccggtctgaggatggaggctgactattacngtncagcagtgggatgacagctgaatgctctatgtcttcggactggaccaaggtcacgtcaggtcagccaagcccaaccntgcactctcgtcccncctcnactcacgtnactgacgcggnngggcaaggcanatagnnnnnnnnn

SEQ ID NO: 17329 - DNA, 453 bp, Homo sapiens
  misc_feature: GYAE6OF01AC8QY.34.33.C11.1.454.CMB.1.raw
  modified_base (374)..(374): a, c, t, g, unknown or other
  misc_feature (374)..(374): n is a, c, g, or t
  modified_base (443)..(453): a, c, t, g, unknown or other
  misc_feature (443)..(453): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcagtgggatgacagcctgaatggctctatgtctcggactgggaccaaggtcaccgtctaggtcacgcccaaggcccaacccntcgtccactctcgttccccgccctcctcatccacgttgtactgacgcgggctgggacaaggcgcagtgnnnnnnnnnnn

SEQ ID NO: 17330 - DNA, 458 bp, Homo sapiens
  misc_feature: GYAE6OF01CH5RW.34.33.C11.1.454.CMB.1.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (446)..(458): a, c, t, g, unknown or other
  misc_feature (446)..(458): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtntgaggatggaggctgactattactgtgcagcagtgggatgacngcctgaatggcttntatgtcttcggaactgggaaccaggtcaccgtctaggtcacgcccaaggcccaaccccatcgtaccaccttctcgttcccccgccctcctcactccacggttctaccgtgacggcgggtctcgggacgaggccactaagtgnnnnnnnnnnnnn

SEQ ID NO: 17331 - DNA, 535 bp, Homo sapiens
  misc_feature: GYAE6OF01E5MDL.34.33.C11.1.454.CMB.1.raw
  modified_base (280)..(280): a, c, t, g, unknown or other
  misc_feature (280)..(280): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
tcagtacacgtgatcacgaccggtgctcgatttagagtgagctcgttgggtttgggggggtctcaggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgatttataagtctgtctcctggtaccaacaacacccggnaaagcctaccaaactcatcgatttatgatgtacaataactcggccctnaggtgttcncatcgcttctctgcctcatgtctggcaacaccgtcctccctagaccactctctcgacctcgaggtctgaggacgaggtgtattagttactgcgcctcatatacacttctactcgtaccactctcgatgtgtacgtttcggacggtacggaccaaccgtccgtacccgttccttaccgtacacgtcccgtacggtcccg

SEQ ID NO: 17332 - DNA, 444 bp, Homo sapiens
  misc_feature: GYAE6OF01CFC5C.34.33.C11.1.454.CMB.1.raw
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (435)..(444): a, c, t, g, unknown or other
  misc_feature (435)..(444): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcagggggtccctgaccgattctctggctccaagtctggcacctcagcctccctggccatcagtgggctccggtctgaggatgaggctgactattactgtgcagcatgggatgacagcctgaatggctcctatgtctcggaactgggaccaggtcaccgtctaggtcagcccaaggcccaacccnctgtcactctcgttcccaccctcctcactcacgtgtacngacgcggctggcaggcncatgnnnnnnnnnn

SEQ ID NO: 17333 - DNA, 732 bp, Homo sapiens
  misc_feature: GYAE6OF01CYWBT.34.33.C11.1.454.CMB.1.raw
  modified_base (316)..(316): a, c, t, g, unknown or other
  misc_feature (316)..(316): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcggtggcccgagtcgtgtgctgactcagcccaccctcagcgtcgtcggggaccccggcagacgggtcaccatctcttgtctggaagcagctaccaacatcggaagtaatactagtaaactggtttacagacaactcccgaggaaccggacccccaaactccncactccaatagtaataactcaggaccgccctacgacgggtccctacgaaccgtattcctacgttcggacctaccgtaaacgtccgttcgggacctacccgtctaaccggtccccttacccgttggaccctaacgtccgtaacggtcggggacccgttacccgggttccgttagggaacgggtacgtacgggtaaccggttcgttacggtaacctttaacgttttaacgtcggtacgtcgaaggtccgtaaggttacggggaatttacggaacgtaacggtcccgtaaggtaaacgttcggaccctttacgttagttaccggttaccgttaccgggaaaccgttacggggtaacccgaaacgggttaccccgtacccgttacccggttaaacggttcccgacccggtaaacccccgg

SEQ ID NO: 17334 - DNA, 443 bp, Homo sapiens
  misc_feature: GYAE6OF01CZMD2.34.33.C11.1.454.CMB.1.raw
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
  modified_base (436)..(443): a, c, t, g, unknown or other
  misc_feature (436)..(443): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctctatgtcttcggaactgggaccaaggtcacgtctaggtcagcccaaggcccaacccnctcgtcactatcgttcccaccctctcatccacgtgtactgagcggctggcaaggcganatagnnnnnnnn

SEQ ID NO: 17335 - DNA, 470 bp, Homo sapiens
  misc_feature: GYAE6OF01EUZIO.34.33.C11.1.454.CMB.1.raw
  modified_base (264)..(264): a, c, t, g, unknown or other
  misc_feature (264)..(264): n is a, c, g, or t
  modified_base (451)..(451): a, c, t, g, unknown or other
  misc_feature (451)..(451): n is a, c, g, or t
  modified_base (454)..(470): a, c, t, g, unknown or other
  misc_feature (454)..(470): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcacgcctccctggccatcagtcggctccggtntgaggatgaggctgactattactgtgcagcatgggatgacagcctagaatggctcctattgtcttggaactgggaccaaggtccaccgtctagtcacgcccaaggcccaacccatcgtacactctcgttccccaccctcctactactcacgttctacgtgacggccgcgtggacgaggccgcatagnagnnnnnnnnnnnnnnnnn

SEQ ID NO: 17336 - DNA, 471 bp, Homo sapiens
  misc_feature: GYAE6OF01DEES9.34.33.C11.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (451)..(471): a, c, t, g, unknown or other
  misc_feature (451)..(471): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggccccaaactcctcatccatagtaataatcagcggccctcgaggggtccctgaccgattctctggctccaagtctggcacctnacgcctcctggccatcagtggctcggtntgagatgaggctgactattactgtgcagcagtgggatgacagctagatggactctatcgtcgttcggaacgtcggaacctaaggtccaccgttctagggtcaaccgacccaaacggccccaaaccccatcgtctaccgtctcgttacccccacctctcgactccgtaacgttcttacgagacgggccgggatcgggacgaaggcgtacagtagnnnnnnnnnnnnnnnnnnnnn

SEQ ID NO: 17337 - DNA, 463 bp, Homo sapiens
  misc_feature: GYAE6OF01AMW5D.34.33.C11.1.454.CMB.1.raw
  modified_base (376)..(376): a, c, t, g, unknown or other
  misc_feature (376)..(376): n is a, c, g, or t
  modified_base (449)..(463): a, c, t, g, unknown or other
  misc_feature (449)..(463): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcagtgggatgacagcctgaatggctctatgtcttcggactgggaccaaggtcaccgtcgtaggtcacgcccaaggcccaacccntcgtcactctcgttccccgccctcctcactcacgtcgtactgacggtcgggctcgggcaagggcagagtacgnnnnnnnnnnnnnnn

SEQ ID NO: 17338 - DNA, 197 bp, Homo sapiens
  misc_feature: GYAE6OF01ELAGX.34.33.C11.1.454.CMB.1.raw
  modified_base (195)..(197): a, c, t, g, unknown or other
  misc_feature (195)..(197): n is a, c, g, or t
tcagtacacgtgatcacgaccggtgctcgatttagagtgagctcgttgggtttggttcagcctccaccaagggcccatcggtcttccccctggcaccctcctccaagagcacctctgggggcacagcggccctgggctgcctggtcaaggactacttccatcacgtgtactgagcgggctggcaaggcgcatagnnn

SEQ ID NO: 17339 - DNA, 753 bp, Homo sapiens
  misc_feature: GYAE6OF01EO9IS.34.33.C11.1.454.CMB.1.raw
  modified_base (211)..(211): a, c, t, g, unknown or other
  misc_feature (211)..(211): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcgagggtcgtcgggcccagtctgtgctgactcagccacctcagcgtcgtcggggacccccggnaggacgggtcacctattccttcttcggttctagggaacgcagcctaccgaactagtacggaaagttaattacgtagttaaacgttggtttacacgacctaacctaccgaacggaacccggaccccccaaacgtcctacactacctaagttaacgtaataactcacggccggtaccctacggacgggtccctaggtaacccgtattaccgtcgtcggctaacccgtaacgtccgtcggacctaccctaccgacgtaccccgttcccgtagggaccctaacgtccgaggttccgggtccttaccggtcgtaggacggacgtgggtacggtcgtacgtaacgttacgtttaacgtcggtacgacgtacggtacgtaggtagggtaacttacggaactaccggtaccgtaaggtacgttcggtacccttacgtttacgttaccggttcccggttaaacggtaccggttacggggaaacccgttaaaccgggtcccggttaaaccccgttcggttaaaccgggtccgaacccgggtaaaccccccgg

SEQ ID NO: 17340 - DNA, 626 bp, Homo sapiens
  misc_feature: GYAE6OF01B9BKI.34.33.C11.1.454.CMB.1.raw
  modified_base (599)..(626): a, c, t, g, unknown or other
  misc_feature (599)..(626): n is a, c, g, or t
tcagtacacgtgatcacgaccggtgctcgatttagagtgagctcgttgggtttggggacccccgggcagagggtcaccatctcttgttctggaagcagctccaacatcggaagtaatactagtaaactggtttcagcaactccaggacgccccaaactcctcatccatagtaataatcagccggcctcgacggggtccctcgaccgtattcctcgtggtcctaccaacgtctcgggacctaccgtccacgtccctccgtcggcctaatcgaggtcggccgtcggtcgtggaggatggaggtctagtacttactagtgtcgcaagcgtaggtacgggtatcgaccgacgccgtaggtacgtcggtacctttccgtagtttacgtccggttacggtaacggtacgggaaccgtacggtaccgtaacccgttcgtacgggtaccaccggacccgaaaccggtaccccaaccctcgtccgtaccgtaaccttccctacccggttacccctcccttacccaacgtcgttaacccgtacggttacgtaacggtacgggaccgggtaccgggtcttaaggggacccgttaagggcctacgtagagnnnnnnnnnnnnnnnnnnnnnnnnnnnn

SEQ ID NO: 17341 - DNA, 619 bp, Homo sapiens
  misc_feature: GYAE6OF01A0DP4.34.33.C11.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (469)..(469): a, c, t, g, unknown or other
  misc_feature (469)..(469): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctcgggaccccgggnagaggtcaccatctcttgttctggaagcagctccaacntacggaagtaatactgtaaactggttcagcaactccaggaacgccccaatcctcatccatacgtaatatcacgccggtaccctcgaacggggtccctaggacccgtattccgtctcggtcctaccgaagttctacggcaccttcgacgcccctaccgtcggaccagtccaggtcgggtcctccggtctggagtagtcgaggtcgtacgtacttagtttaccgnggttagaccgtagaccgtaaggtcggggtactaggaccgtacgtaccgtagtaacgtcggtcctacgttagttcggttccgttacgggtaaccgtcgggaacctaacggttcccgtaccggttaccgtacggtacccgacggtaaccccg

SEQ ID NO: 17342 - DNA, 654 bp, Homo sapiens
  misc_feature: GYAE6OF01DOMQ2.34.33.C11.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
tcagtacacgtgatcacgaccggtgctcgatttagagtgagctcgttgggtttggggcagcttcagctgtgggttgagaagacaggactcaggacagtctacagcatggccagcttccctctcctcctcaccctcctcactcactgtgcagggtcgtgggcccagtctgtgctgactcagccaccctnagcgtcgtcgggaccccggnaggacgggtcaccatctcttgttctggaacgcagcctaccaaactagtacggaaagtaactactagtaaaacgttggtttacacgaccaactcccgacggaacccggacccccaaacctcctactactaccaagtaacgtaaataactcacggccggtccctacgtacgggtccctgaccgtacttcctcgtcggctactaacgtcgtacggccacctcacgtccctccgtgccatcgacggtcgggtcctccgggtctaggaggtactcgggaacggtcctagtaacttacgtttactggtacgcgaacgtctaggtcggggtaattcggaacctggtaccgtaggaacgtcggtaccttacgtagttcgttaccggttacgggtaacgtacgggtaaacctaacggttcctaacccggttacgtacggccctacggaaccccgg

SEQ ID NO: 17343 - DNA, 457 bp, Homo sapiens
  misc_feature: GYAE6OF01EYCSQ.34.33.C11.1.454.CMB.1.raw
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (410)..(410): a, c, t, g, unknown or other
  misc_feature (410)..(410): n is a, c, g, or t
  modified_base (441)..(457): a, c, t, g, unknown or other
  misc_feature (441)..(457): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctgaggggtccctgaccgattctctggctccaagtctggcacctcancctccctggccatccaggtcgggctccggtntggaggatgaggctgattattactgtcagtcctttgacagtcagccgtgagtgcttagtgtcttggactgggaccaagtccaccgtcctggtcacgcccaagtcccaacccatcgcactctcgtccccgcctctcactcacgtntactcggagcggctggcaaggtccacatagnnnnnnnnnnnnnnnnn

SEQ ID NO: 17344 - DNA, 449 bp, Homo sapiens
  misc_feature: GYAE6OF01DT2RH.34.33.C11.1.454.CMB.1.raw
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
  modified_base (438)..(449): a, c, t, g, unknown or other
  misc_feature (438)..(449): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacgcccccaaactcctcatccatagtaataatcagcggccctcagggggtccctgaccgattctctggctccaagtctggcacctcagccctccctggccatcagtggctccggtctgaggatgaggctgactattactgtgcagcagtgggatgacagcctgaatcggcctcctatcgtcgttacgggaactcggggaaccaggtccaccgtcctaggcacgacccaacgcccaacccnctcgtccactctcgtcccccaccctcctcactcacgttcgtactggacggcgggcnggtacgaaggcnctaagtnnnnnnnnnnnn

SEQ ID NO: 17345 - DNA, 461 bp, Homo sapiens
  misc_feature: GYAE6OF01CT2PM.34.33.C11.1.454.CMB.1.raw
  modified_base (271)..(271): a, c, t, g, unknown or other
  misc_feature (271)..(271): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (427)..(429): a, c, t, g, unknown or other
  misc_feature (427)..(429): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (438)..(461): a, c, t, g, unknown or other
  misc_feature (438)..(461): n is a, c, g, or t
tcagtacacgtgatcacgaccggtgctcgatttagagtgagctcgttgggtttggggggccgttcctggaagcagctccaacatcggaagtaatactgtaaactggtttcagcaactcccaggaaccggcccccaaactcctcatccatagtaataatcagcggccctaaggggtccctgaccgattctctggctccaagtctggcacctcagccctccctggccatcgagtgggcctccgggtctggaggatggaggctgacttattacngtgcagccatggggatgacagcctgaagtggctcctatgtcttcggactgggaccaaggtccacgtcgtaggtccagccaacggcccaacccnctcgcactctcgtccccncctcncntcncgtntacgngagcgggctggcaacggcacataggnnngtcntnntnnnnnnnnnnnnnnnnnnnnnnnn

SEQ ID NO: 17346 - DNA, 637 bp, Homo sapiens
  misc_feature: GYAE6OF01D4JUW.34.33.C11.1.454.CMB.1.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (589)..(590): a, c, t, g, unknown or other
  misc_feature (589)..(590): n is a, c, g, or t
  modified_base (592)..(592): a, c, t, g, unknown or other
  misc_feature (592)..(592): n is a, c, g, or t
  modified_base (599)..(600): a, c, t, g, unknown or other
  misc_feature (599)..(600): n is a, c, g, or t
  modified_base (604)..(604): a, c, t, g, unknown or other
  misc_feature (604)..(604): n is a, c, g, or t
  modified_base (613)..(615): a, c, t, g, unknown or other
  misc_feature (613)..(615): n is a, c, g, or t
  modified_base (617)..(618): a, c, t, g, unknown or other
  misc_feature (617)..(618): n is a, c, g, or t
  modified_base (622)..(627): a, c, t, g, unknown or other
  misc_feature (622)..(627): n is a, c, g, or t
  modified_base (630)..(632): a, c, t, g, unknown or other
  misc_feature (630)..(632): n is a, c, g, or t
  modified_base (634)..(635): a, c, t, g, unknown or other
  misc_feature (634)..(635): n is a, c, g, or t
  modified_base (637)..(637): a, c, t, g, unknown or other
  misc_feature (637)..(637): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggttcagcaactccaggaaccgccccaaactcctcatccatagtaataatcagccgccctcgacggggtccctgaccgtattctcgtggctccaagtcgtcggccacctcacgtccctccgtgccatcgaggtcggcctccggtntaggaggagtggacggctagacttagttactgngcagctaggtggtatgaccgacgtccgtaggtacgtcggtacttcttagttcgtaccgttacggaacgtcgggaaccctaggtccgtaaccgttcgtacgtacccgaaccggacccgaaaacccggtcccctaaacccgtgttacccggtacctaaccgtttcccgttccccggttacccccgaccctttcaaccgttacgttaccgtaccgggttacggttacccgcgggaacgggtccgggtaccgtaacggggaccgttaaacgccggtaactaggtacgnngntgcgtcnncgcncgcgtcgcnnncnncgcnnnnnntcnnncnngn

SEQ ID NO: 17347 - DNA, 494 bp, Homo sapiens
  misc_feature: GYAE6OF01DFVTC.34.33.C11.1.454.CMB.1.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (466)..(494): a, c, t, g, unknown or other
  misc_feature (466)..(494): n is a, c, g, or t
tcagtacacgtgatcacgaccggtgctcgatttagagtgagctcgttggggtttgggggccgttcctggaagcagctccaacatcggaagtaatactgtaaactggtttcagcaactcccaggaaccggcccccaaactcctcatccatagtaataatcagcggccctcaggggtccctgaccgtattctctggctccaagtctggacacctcagccctcctggcccatcaggtgggcctccggtctggaggatggaggtctgatttacttacgtgccttgtcctaagtgaacaagacgtcctgtacttgtttatcgtcgtttacgggaacgtgggaaccaaggtcaccggttccttggtacacgacccaacggacccaaccccntcgtcacgtctcgttccccnccctccncgactcgacgtcgtactcggacgcgggctggacgaagggtccacgaagtgctgnnnnnnnnnnnnnnnnnnnnnnnnnnnnn

SEQ ID NO: 17348 - DNA, 641 bp, Homo sapiens
  misc_feature: GYAE6OF01A4X3Q.34.33.C11.1.454.CMB.1.raw
  modified_base (610)..(610): a, c, t, g, unknown or other
  misc_feature (610)..(610): n is a, c, g, or t
  modified_base (612)..(614): a, c, t, g, unknown or other
  misc_feature (612)..(614): n is a, c, g, or t
  modified_base (616)..(616): a, c, t, g, unknown or other
  misc_feature (616)..(616): n is a, c, g, or t
  modified_base (618)..(641): a, c, t, g, unknown or other
  misc_feature (618)..(641): n is a, c, g, or t
tcagtacacgtgatcacgaccggtgctcgatttagagtgagctcgttggggtttggggacccccgggcagagggtcaccatctcttgttctggaagcagctccaacatcggaagtaatactgtaaactggtttcagcaactccaggaacggcccccaaactcctcatccatagtaataatcagcggccctcaggggtccctgaccgattctctggctccaagtctggcacctcacgcctccctggccatcaggtcgggcctccggtctgaggatggaggctgtacgtattacgtgtcgcagcagtgggatgaacgacgcctagaatcggtcctaccgttagttcgttaccgttacgggtaaacgtcggggtaaaccctaacgggtccctaacccggttccgtaaggtcccgaaaccgaccccgaaaacggaccccctaaaacccccgtcgtttaccggacctaacccgtttcccgttaccccggtttacccccctaaccccccttccttaccctaacttacccgtaacccggttagttaaccccggtagggaacccgggccggggtacctacggggaactaaaccgggggccttaaccgagttaaccggnannngncnnnnnnnnnnnnnnnnnnnnnnnn

SEQ ID NO: 17349 - DNA, 481 bp, Homo sapiens
  misc_feature: GYAE6OF01B7F1Q.34.33.C11.1.454.CMB.1.raw
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (467)..(481): a, c, t, g, unknown or other
  misc_feature (467)..(481): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagccctccctggccatcagtcgggctccggtctgaggatgaggctgactattactgtgcagcagtgggatgacagcctgaatgactctatgtcttacggaactcggaccaaggtccaccgtctaggtcacgacccaacggcccaaccctntcgtcctactccttccgtccccgcccttccncactccacgttgtacgnggacggcgggtcngggactaacgggccactatacgnnnnnnnnnnnnnnn

SEQ ID NO: 17350 - DNA, 732 bp, Homo sapiens
  misc_feature: GYAE6OF01A1SVK.34.33.C11.1.454.CMB.1.raw
  modified_base (663)..(663): a, c, t, g, unknown or other
  misc_feature (663)..(663): n is a, c, g, or t
  modified_base (670)..(670): a, c, t, g, unknown or other
  misc_feature (670)..(670): n is a, c, g, or t
  modified_base (687)..(687): a, c, t, g, unknown or other
  misc_feature (687)..(687): n is a, c, g, or t
  modified_base (697)..(697): a, c, t, g, unknown or other
  misc_feature (697)..(697): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccgaggaaccggcccccaaactcctcatccatagtaataatcagccggccctcgacggggtccctgaccgtattctcgtggcctaccaacgtctcggccacctcacgccctcccgtcggcctactcgacggttcgggtccgttcccggtcgtaggacggatggacggtctgtaacttagttacgtggtcgacaggtcgtaaggtcgggtactacggaacgccggtaccgttaggtaacgttcggtacctttaccgtaagttccggttaccggtttaaccgggaaaccgttacggggaaccctaacgggttcccgaacccgttaccggtaacggaccgaacccggtaacccgaaacccggacccctaaaccccgtcgttaccggtaccctaccgtttcccgttcccgttacccccgtacccttacgtaccctacgttaccggtacggtttacgtaccggtacgggtaccgggccgggtaacggtcccgggaacgggaaccgggccgttaacgtaaccgggtancgtacgngaccagcactcgacgcncgcgctcacncgtcncgtctnacgcgcgcgcgtcatancncngtg

SEQ ID NO: 17351 - DNA, 682 bp, Homo sapiens
  misc_feature: GYAE6OF01EXQED.34.33.C11.1.454.CMB.1.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (600)..(600): a, c, t, g, unknown or other
  misc_feature (600)..(600): n is a, c, g, or t
  modified_base (609)..(609): a, c, t, g, unknown or other
  misc_feature (609)..(609): n is a, c, g, or t
  modified_base (619)..(619): a, c, t, g, unknown or other
  misc_feature (619)..(619): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (653)..(653): a, c, t, g, unknown or other
  misc_feature (653)..(653): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactccaggaacggccccaaactcctcatccatagtaataatcagcggcctcgacgggtcctgacgattctctggctcagtctggcacctcacgccctcctggccnctcacgtcggccgtccggntcggaggtatggaggtctagtactttattacgtcgtactacgttccttagacgagtcacgtccgtgtcggtttacgcttttaacgtcggttaccgttaccgggtaacgtacggggtaaccgtaacgggtcccaacccggtttcccggaacggttccgaaacccaaccccggtaaacggacccccctaaacccgtacgttaccgtccgtaacctttcccgttacccgttacccctccccttccgtacctacgtaccgtacggttaccgttacgtcgggtacccgggtacggtaccggtacgggaccgttaacgggaccgtaacggtaaccgtaaggctgngtacgtacngtcacgtcgngtcgacgtcnctcacgtntactcgtgtacgtcgngacgcgtcgtctacgtctctagcngngcg

SEQ ID NO: 17352 - DNA, 575 bp, Homo sapiens
  misc_feature: GYAE6OF01BPCBG.34.33.C11.1.454.CMB.1.raw
  modified_base (545)..(546): a, c, t, g, unknown or other
  misc_feature (545)..(546): n is a, c, g, or t
  modified_base (548)..(575): a, c, t, g, unknown or other
  misc_feature (548)..(575): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggcccccaaactcctcatccatagtaataatcagcggccctcgacggggtccctgaccgattcctctggctcagtctggccacctcacgcctccctggccatcgacggtgggcctccggtctggaggatggagctagactatttacgtgtgcgagcagtggatgacagcctagaacgtcggtccttactagtcggttacgttacggaacgtcgggaacctacggtacctacccggtccgtaggtccacggtaccccgaacggtacccccaaacccgtgtacgtaccgaccctttccgtcccgtttccccccgacccctttcccgtactaccgttaccgtaccgtttcggtaaccgtcgggacgggcccgggttaccgtacgggaccgaaacgggtccgaacgtaacgtggnngnnnnnnnnnnnnnnnnnnnnnnnnnnnn

SEQ ID NO: 17353 - DNA, 587 bp, Homo sapiens
  misc_feature: GYAE6OF01D2XQ6.34.33.C11.1.454.CMB.1.raw
  modified_base (181)..(181): a, c, t, g, unknown or other
  misc_feature (181)..(181): n is a, c, g, or t
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
  modified_base (576)..(576): a, c, t, g, unknown or other
  misc_feature (576)..(576): n is a, c, g, or t
tcagtacacgtgatcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgcttaaaccgggacaaccgtcgcccggcaacatagccttctcccgtcccccttgcagtaacaccaagtacaggaatattaacctgttccatcgactacgcctttcgcctcgccttaggggtcactcaccctgcccgattaacgtggacaggacccttggtcttccggcgagcgggcttttcacccgtctttatcgttacttatgtcagcattcgctacttctgactaccctccagtcactcgccctcacacgccacaccttcacnggtacttacacgaccncctacccctaacccaacaacgcaataacgccgtcnctcgcccncagtccttcggcgctagttcggtttacnccccgttanacgttccttcccgcgaccacggcccncgtccgaaccg

SEQ ID NO: 17354 - DNA, 592 bp, Homo sapiens
  misc_feature: GYAE6OF01BU6WR.34.33.C11.1.454.CMB.1.raw
  modified_base (183)..(183): a, c, t, g, unknown or other
  misc_feature (183)..(183): n is a, c, g, or t
  modified_base (297)..(297): a, c, t, g, unknown or other
  misc_feature (297)..(297): n is a, c, g, or t
  modified_base (470)..(470): a, c, t, g, unknown or other
  misc_feature (470)..(470): n is a, c, g, or t
  modified_base (509)..(509): a, c, t, g, unknown or other
  misc_feature (509)..(509): n is a, c, g, or t
  modified_base (568)..(592): a, c, t, g, unknown or other
  misc_feature (568)..(592): n is a, c, g, or t
tcagtacacgtgatcacgaccggtgctcgatttagagtgagctcgttggggtttggggacccccgggcagagggtcaccatctcttgttctggaagcagctccaacatcggaagtaatactgtaaactggtttcagcaactcccgaggaaccggcccccaaactcctcatccatagtaataancagcgccctgaggggtcccctgacccgtattcctcgtcggcctaccaaggtctcggccaccctacacgccctcccgtcggaccatcgaggtcgggcctccggtctggagatggnggctgacttattacgtgtgcacgcgtaggtggggaactcgaacgacgtacgtagaacgttcgggtccttacctacgttcggttccggttaacggtaaccggtccgggtaacccgtaacgggtcccgtaccgtacggtacggaccgtaccgacccgaaccggaaccccaacccnttaccgactacccgtccgttcccgtaccccgcccttacnctaccgtcgaacttcgtacgtcgacgggccgggtatgggaccacggtcctagaccggtnnnnnnnnnnnnnnnnnnnnnnnnn

SEQ ID NO: 17355 - DNA, 831 bp, Homo sapiens
  misc_feature: GYAE6OF01DBF2O.34.33.C11.1.454.CMB.1.raw
tcagtacacgtgatcacgaccggtgctcgatttagagtgagctcgttgggtttggggcagcttcagctgtgggttgagaagacaggactcaggacagtctccagcatggccagcttccctctcctcctccaccctcctcactcactgtgcagggtcgtgggcccagtctgtgctgactcacgccaccctcacgcgtccgtcggggaccccggcaggacgggtccacctacttcttctttcgttcgtaggaacgcacgtcctaccaaacacgtacggtaaagtaactacgttaagttaaacgtttggtttaccacgtacctaacctcccgaacggtaacccggaaccccctaaacgtcctactactacctaataacgttaaactaacgtccgaacggtccggtaccccgtacgggtaccggggtaccctacggtaacccgttacgtttaccgtacggttcggaccctttaaccggtaaacggttccggtaccgggaccctacccgttaccgtaacccgttcccctacccggttcggtacccctagttacccggtacggggttccggggtccctttacccgggttacgttaacggggaacggttacggtcggtaacgggtccttacgttaacctttaagtttcggtttaggcgtaacgacgtacggtacggtaagggtacgtacggaacgtacggtacgttaacggaacgttccggtaccctttacggttacgttacggttaccgttaacgggtaacggttacgggtaaacccgtaacgggttcccgtaacccggttacggttaaccgggaccgtaacccggtaaacccccgg

SEQ ID NO: 17356 - DNA, 1017 bp, Homo sapiens
  misc_feature: GYAE6OF01AHJPS.34.33.C11.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (659)..(659): a, c, t, g, unknown or other
  misc_feature (659)..(659): n is a, c, g, or t
  modified_base (731)..(731): a, c, t, g, unknown or other
  misc_feature (731)..(731): n is a, c, g, or t
tcagtacacgtgatcacgaccggtgctcgatttagagtgagctcgttgggtttggggcagcttcagctgtgggttgagaagacaggactcaggacagtctccagcatcggccagcttccctctcctcctcaccctcctcactcactgtgcgtagggtcgtcgggccagtctgtgctgactcacgcccacctnacgtcgtcgtacgggaccccggnacggacggtccaacctctcttcgttcgttcgtagggaactccgacgtacctaccgaaacgtacggttaacggtaaagttaaacgttaacgttaacgttaaaccgtttcggtttaccaacgtacctaaacccgttaccggaaccggaaaccccggtaacccccctaaaccttccctaccgaaccttaccgtaagttaaacgtaacttaacgtacgaaccggtcccgggtacccgttacgggtaccggggttaccccgtacggttaacccgttacgttttacccgtcggtaccgtacccgttaaccgtacgggttccgttaccgggtaacccctacccgtacggacccgttccccgttacccggtacggtacctaccgggttacccggtacgggttacccggggtcccgtttcccgggttaaccggtacggtaaccgggtttaacnccggggtttaaccgggtaccgtttaccgttaaacccgttttaccggttttaccggttacgggttaaccccgnggttaaacccgggtaaccggttaagggttacggggttaaccgttacgggtaacccggtaaaccggtttacccggggtaaccgttttaaaccgggccgggtttttacccccttaaaccgggttttaccggtttcccggggtttaacccgggttttaaacccgggggtaaaacccggttacccgggggttaaaacccccgttttaaacccgggtacccccgggttaaccccggtttaacccggggtaacccggttaaccccggtaaacccccgggttaaacccccggg

SEQ ID NO: 17357 - DNA, 569 bp, Homo sapiens
  misc_feature: GYAE6OF01BKW6H.34.33.C11.1.454.CMB.1.raw
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (545)..(550): a, c, t, g, unknown or other
  misc_feature (545)..(550): n is a, c, g, or t
  modified_base (552)..(569): a, c, t, g, unknown or other
  misc_feature (552)..(569): n is a, c, g, or t
tcagtacacgtgatcacgaccggtgctcgatttagagtgagctcgttgggtttggggaccccccgggcagagggtcaccatctcttgttctggaagcagctccaacatcggaagtaatactgtaaactggtttcagcaaactcccaggaacggcccccaaactcctcatccatagtaataaatcagcggccctcgaggggtccctgaccgattctctggctccaagtctggcacctcacgcctcccgtggccatcaggtcggctccggtctggaggatggaggctagacttagttactggtgacagcgatgggggaatgaactgcctaggaagttcggcttaccgtagttcgttcgttaccgggaacgtagggaaccctaaagggtcccgtacccgtacgtacggtcaaccggacccaaacggaccccaacccgtacgttacgcctaccttccgttcccgttcccccggtccccttccgtacctactaccgtacgttactacggtgaccgggtcggcgtcggacgacggctacagtagnannagnnnnnnannnnnnnnnnnnnnnnnn

SEQ ID NO: 17358 - DNA, 681 bp, Homo sapiens
  misc_feature: GYAE6OF01DC2DR.34.33.C11.1.454.CMB.1.raw
  modified_base (589)..(589): a, c, t, g, unknown or other
  misc_feature (589)..(589): n is a, c, g, or t
  modified_base (641)..(641): a, c, t, g, unknown or other
  misc_feature (641)..(641): n is a, c, g, or t
  modified_base (646)..(681): a, c, t, g, unknown or other
  misc_feature (646)..(681): n is a, c, g, or t
tcagtacacgtgatcacgaccggtgctcgatttagagtgagctcgttggggtttgggggccgttcctggaagcagctccaacatcggaagtaatactgtaaactggtttcagcaactcccaggaaccgccccccaaactcctcatccatagtaataatcagccggccctcgacgggggttcccctgaccgattctctggcctacaagtctggccacctcacgccctcccgtggaccctatccgaggtcggggcccttcccgggttctaggagggtactgggaacggtccttaggtactttacgtttacgtggtagaccacggtcgtaaggttggggaacttaccggaaccgtaccggtcccgttaaggtaagttccgggtacccctttacgttagtttccggttaccggtttaaccggggaacggttccggggaaaccgtaaccgggttccacccggttaccgtttaggaccccgaaccgacccccgaacggaccccctaaaccccgtgtttccggtaccctaccttcccgtttacccgttccccccgtaccccttccaacctacgttaccgtacggtttacgtaccgngggtaccgggtccgggtaccgtcgggaaccggaacggtcccacgtagtcggntcgannnnnnnnnnnnnnnnnnnnnnnnnnnnnnnnnnnn

SEQ ID NO: 17359 - DNA, 633 bp, Homo sapiens
  misc_feature: GYAE6OF01DC9VT.34.33.C11.1.454.CMB.1.raw
  modified_base (274)..(274): a, c, t, g, unknown or other
  misc_feature (274)..(274): n is a, c, g, or t
  modified_base (604)..(604): a, c, t, g, unknown or other
  misc_feature (604)..(604): n is a, c, g, or t
  modified_base (608)..(633): a, c, t, g, unknown or other
  misc_feature (608)..(633): n is a, c, g, or t
tcagtacacgtgatcacgaccggtgctcgatttagagtgagctcggttgggtttgggggccgttcctggaagcagctccaacatcggaagtaatactgtaaactggtttcagcaactcccaggaaccgccccaaactcctcatccatagtaataatcagccggccctcgaggggtccctgaccgtattcctctggcctaccgaagtcgtggaccaccctcacgtccccttcccgtcggcctaactccgtacggtcggggcccgtcccgggggtntaggaagggtatacgggacggtacttaggtaattttaaccgtttagtcgttacttaacggtttcccttttacgaaccgtacggactacggtaccgttggaacggttcgttactttaacgttcggtttaaccggttaacgggtaaaccggtaccgggtaaaaccgtaaccggtaccgtacccggttaccggtaaggacccaaccggaacccgaaaccggtaccccaaaccctcgtacgtacctaccttacccgttccgttcccccacccgttcctacgtacctacgtacgtcgtacgtggtacgggtccggtgacggacggagcgacgtanacgnnnnnnnnnnnnnnnnnnnnnnnnnn

SEQ ID NO: 17360 - DNA, 634 bp, Homo sapiens
  misc_feature: GYAE6OF01D0V6O.34.33.C11.1.454.CMB.1.raw
  modified_base (584)..(584): a, c, t, g, unknown or other
  misc_feature (584)..(584): n is a, c, g, or t
  modified_base (603)..(603): a, c, t, g, unknown or other
  misc_feature (603)..(603): n is a, c, g, or t
  modified_base (606)..(608): a, c, t, g, unknown or other
  misc_feature (606)..(608): n is a, c, g, or t
  modified_base (610)..(611): a, c, t, g, unknown or other
  misc_feature (610)..(611): n is a, c, g, or t
  modified_base (613)..(614): a, c, t, g, unknown or other
  misc_feature (613)..(614): n is a, c, g, or t
  modified_base (618)..(619): a, c, t, g, unknown or other
  misc_feature (618)..(619): n is a, c, g, or t
  modified_base (621)..(622): a, c, t, g, unknown or other
  misc_feature (621)..(622): n is a, c, g, or t
  modified_base (624)..(626): a, c, t, g, unknown or other
  misc_feature (624)..(626): n is a, c, g, or t
  modified_base (628)..(632): a, c, t, g, unknown or other
  misc_feature (628)..(632): n is a, c, g, or t
  modified_base (634)..(634): a, c, t, g, unknown or other
  misc_feature (634)..(634): n is a, c, g, or t
tcagtacacgtgatcacgaccggtgctcgatttagagtgagctcgttgggtttcggggacccccgggcagagggtcaccatctcttgttctggaagcagctccaacatcggaagtaatactgttaaactggtttcagcaactccgaggaaccggccccaaactcctcatccatagtaataatcagccgccctcgacggggtccctgaccgatttctcgtcggcctaccgaacgttctcgttaccacctcgaccgcccttcccgtcggcctaacgtcgacgggtcggtccgttccgggtcgtggaggtgtggacggtctaggtaactttagttcgtggtcgcgagcgtaggtgggactagacgcgtcgtagtagtccgtacttcgtagttcgttacgtacggacgtacggacgtacggcctaccgttcgtacgcacccgaccgtaaccgaccccaccgtatcccgtactacccgttcgttccccgttcccccgccttaccgtacctaccttaccgggtacgtttacgtacggtacggggcggccgggtacgttacgggaaccggaaggtccttaacggagtcganggctgggcaacggctagcncgnnngnngnncgcnncnncnnncnnnnngn

SEQ ID NO: 17361 - DNA, 739 bp, Homo sapiens
  misc_feature: GYAE6OF01EPSFU.34.33.C11.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagtacacgtgatcacgaccggtgctcgatttagagtgagctcgttgggtttgggcagcttcagctgtgggttgagaacgacaggactcaggacagtctccagcaatggccagcttccctctcctcctcaccctcctcgactcactgtagcgagggtcgtggcccagtctgtgctgactcacgccaccctnagcgtcgtcgggaccccgnagacggtccaccattcctcttgttacgnggaancgagcctacaacntacgaagtaatactagtaacttggttcagacctaacctccgaacggtacccgacccctaactcctacgactaccgataaagtactaagtcacggccgtaccctacggcgggtaccctacgaccgtacttacgtccgtacggtccttaacgaacgttcggtacggtacccctaaccgtccgaaccggttccccgttcccgttacggggacccctaacgtaaccggtcgggtacgggtcccgttacggtaccgtaggaggtactagggacgtccgttaacgtactttacgttaccgttaggttacagtaccgtaaggtacggtacgtaagtaccggaccgtaccggtaaggtaacgttccgtaccttaccgttaaggttccggtttaacggtaaccggaaccggttacgggaacccgtaacggttacccgtaccggtttaacccgaacgggtcccgtaaacccggcccccgtaaaaccccgggg

SEQ ID NO: 17362 - DNA, 638 bp, Homo sapiens
  misc_feature: GYAE6OF01EUX1O.34.33.C11.1.454.CMB.1.raw
  modified_base (612)..(638): a, c, t, g, unknown or other
  misc_feature (612)..(638): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaaccgccccaaactcctcatccataagtaataatcagcggccctcgacgggtccctgaccgtattctctggtctccgagtctggccacctcacgtccctcctggcctagtcgaggtcgggtcctccggtcgtggaggatggaggtccgtagtaactttagttacgtgtacgacgacgacgaggttagggacgtagaaccgtcgaccgtttaggtaaacggttccgtcccgttacgttacgttcggttacgtttaaccggggaaccgttaccggggtaaccgtaaaccggtcccgtacccggttaaccgtacggtaacccgacccggtaacccgaaaccggtacccccaaccctaccggttctaacccgtctttacccgtccctttaccccccaccctttcctacccgttacttacccgtacgtttaccggcgttacgggaccgggcggtaccgacgggaccgaacgggtcacgttaagcannnnnnnnnnnnnnnnnnnnnnnnnnn

SEQ ID NO: 17363 - DNA, 839 bp, Homo sapiens
  misc_feature: GYAE6OF01C98SB.34.33.C11.1.454.CMB.1.raw
  modified_base (171)..(171): a, c, t, g, unknown or other
  misc_feature (171)..(171): n is a, c, g, or t
  modified_base (225)..(225): a, c, t, g, unknown or other
  misc_feature (225)..(225): n is a, c, g, or t
tcagtacacgtgatcacgaccggtgctcgatttagagtgagctcgttgggtttgggcagcttcagctgtgggttgaagaagacaggactcaggacagtctccagcagtgccagcttccctctcctcctccaccctcctcactcactgtcgcgagggtcgtcggccctagtntgtcgctgacctcacgccctaccctcacggccgtccggccggggacccccgggnacggacgggtccaacctattccttctttcggttacgaggaaacgccgaacgtccctaacccgtaaacgaacggttaacggtaaaacgttaaaatttagttacgtattaacggttcggacctaaccgacgtaccgtaaccgttacccggaaccggaaccccggtaacccctaaacctcctaactaacttacgtaagttaacttaaaacttacgtcgtccggacccggtcccgtaggtaccggtacccgtacgtaaccgttacttccgtccggtacgtaccctaccgtaacgtcccgtacgcccgttacctacccgacccgttcccgtacccctacgggccctaaacggttccggtaaccggggttccgggtacccgttacccggggtaaccgtaagggttacgtacgggtacgttaccgtaaggtttaactttacgttacgtcgttacgaccgttaagacggttaggtacgtacgtagacccgtagtacggttagggggttaagttgggggtttacggggtccgggttaacgggacgggaaccccggttaagacccggttacctaacgggtccccgtttaaacgtggggaacccctcggtaaccccggtaaccgg

SEQ ID NO: 17364 - DNA, 638 bp, Homo sapiens
  misc_feature: GYAE6OF01EEFYB.34.33.C11.1.454.CMB.1.raw
  modified_base (309)..(309): a, c, t, g, unknown or other
  misc_feature (309)..(309): n is a, c, g, or t
  modified_base (605)..(605): a, c, t, g, unknown or other
  misc_feature (605)..(605): n is a, c, g, or t
  modified_base (615)..(638): a, c, t, g, unknown or other
  misc_feature (615)..(638): n is a, c, g, or t
tcagtacacgtgatcacgaccggtgctcgattttagagtgagctcgttgggtttgggggacccccgggcagagggtcaccatctcttgttctggaagcagctccaacatcggaagtaatactgtaaactggtttcagcaactccaggaacggcccccaaactcctcatccatagtaataatcagcggccctcgacggggtccctgaccgattctcgtggcctccaagtcgtggccacctcacgccctcccgtggccatcgaggtcgggccttccggtctgaggatggaggctgacttattacgtggtcncagctaggtgggatacggaccgcgtaccgttaggaacgtcgggtaccttccgttagttcgttccgttaacgggaacgtacgggaccgtaacggtcctaccggtccgtaggtccgaccgtaaccccgaaacggaccccaaaccccgtgttaccgtaccctacgtttcccgttaccccggtttcccccgtcccctttacccgtactaccttacccggtacgtttaccggtacgttacggggaacccgggtcggggtaccctacggggaacccggtacgggaccacgttaagcgagcancgagcagcgnnnnnnnnnnnnnnnnnnnnnnnn

SEQ ID NO: 17365 - DNA, 414 bp, Homo sapiens
  misc_feature: GYAE6OF02GE4JI.34.33.C11.1.454.CMB.1.raw
  modified_base (410)..(414): a, c, t, g, unknown or other
  misc_feature (410)..(414): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgattattactgtcagtcctttgacagcagcctgagtgcttatgtcttcggaactgggaccaaggtcaccgtctaggtcagcccaaggccaaccccactgtccactctgttcccgccctcctcatcacgtgtactgagcgggctggcaaggcgcatagnnnnn

SEQ ID NO: 17366 - DNA, 504 bp, Homo sapiens
  misc_feature: GYAE6OF02FYPZP.34.33.C11.1.454.CMB.1.raw
  modified_base (399)..(399): a, c, t, g, unknown or other
  misc_feature (399)..(399): n is a, c, g, or t
  modified_base (471)..(480): a, c, t, g, unknown or other
  misc_feature (471)..(480): n is a, c, g, or t
  modified_base (482)..(504): a, c, t, g, unknown or other
  misc_feature (482)..(504): n is a, c, g, or t
tcagtacacgtgatcacgaccggtgctcgatttagagtgagctcgttggggtttcggggaacccccgggcacgagggtcgaccaatcctcttgttctggaagcagctccaacatcggaaggtaatacgtgtaaactggtttctagcaactcccaggaacggcccccaaactcctcactccatagtaataatcagcggccctcaggggtccctgaccgattctctggctccaaggtcctggcacctcagccctcctggccatcaggtcggccttccggtctgaggatgaggtctgactattactttcgcagcatgggatggacaggcctgaatggctcctatgtcttcggaactgggaaccaaggtcaccgtcctaggtcacgcccaaggcccaaacccntcgtccactctcgttccccacctcctcatccacgtgtactggacgcgggctgggaccaagggcgacagtagnnnnnnnnnntnnnnnnnnnnnnnnnnnnnnnnn

SEQ ID NO: 17367 - DNA, 503 bp, Homo sapiens
  misc_feature: GYAE6OF02GZX8X.34.33.C11.1.454.CMB.1.raw
  modified_base (207)..(207): a, c, t, g, unknown or other
  misc_feature (207)..(207): n is a, c, g, or t
  modified_base (448)..(448): a, c, t, g, unknown or other
  misc_feature (448)..(448): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctgggacccccggnagagggtcaccatctcttgttctggaagcagctccaacatcggaagtaatactgtaaactggtttcagcaactcccaggaacggcccccaaactcctcatccatagtaataatcagcggccctcgacggggtccctgaccgattctctggctccaagtctgccactcagcctcctggccatcagtcgggcctccggtctgaggatgaggctgacttattactgtgcagcagtgggatgacngcctgatgctctagtgtcttcggactggaccaggtcaccgtctaggtcagacccg

SEQ ID NO: 17368 - DNA, 488 bp, Homo sapiens
  misc_feature: GYAE6OF02FUW5Z.34.33.C11.1.454.CMB.1.raw
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
  modified_base (456)..(463): a, c, t, g, unknown or other
  misc_feature (456)..(463): n is a, c, g, or t
  modified_base (465)..(488): a, c, t, g, unknown or other
  misc_feature (465)..(488): n is a, c, g, or t
tcagtacacgtgatcacgaccggtgctcgattttagagtgagctcgttgggtttgggggacccccgggcagagggtcaccatcctcttgttctggaagcagctccaacatcggaagtaatactgtaaactggtttcagcaactcccaggaacggcccccaaatcctcatccatagttaataatcagcggtaccctcaggggtccctggaccgattctctggctccaagtctggcacctcagcctccctggccatcgagtcggctccggtctgagatgaggctgactattactgtgcagcagtgggatgacagccgtaggatggctctatgtcttacggaactggggaccaagggtccaccgttctaggtcacgcccaaggcccaacccnttgtccacgtctccgttccccaccctcctcactcacgtgtacngacgcggctcggcaagcgcatagnnnnnnnngnnnnnnnnnnnnnnnnnnnnnnnn

SEQ ID NO: 17369 - DNA, 504 bp, Homo sapiens
  misc_feature: GYAE6OF02FYBZK.34.33.C11.1.454.CMB.1.raw
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctgggacccccggcagagggtcaccatctcttgtctggaagcagctccaacatcggaagtaatactgtaaactggttcagcaactcccaggaacgccccaaactcctcatccatagtaataatcagcggccctcgacgggtccctgaccgattctctggctcaagtctggcacctcacgcctcctggccatcagtcggctccggtctgagatggaggctgactattacgtgtgcagctagtgggatgacagcctagaatcgctctagtcgtacttcggaactggaccaggtcaccgtctaggtcagacccg

SEQ ID NO: 17370 - DNA, 635 bp, Homo sapiens
  misc_feature: GYAE6OF02JX7LB.34.33.C11.1.454.CMB.1.raw
  modified_base (302)..(302): a, c, t, g, unknown or other
  misc_feature (302)..(302): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctcgggacccccgggcagagggtcaccatctcttgttctggaagcagctaccaacatcggaataatactgtaaactggttcagcaactccaggaaccgccccaactccncatccaatagtaataatcagccgcctcgacgggtccctagaccgtattctctcggcctacaagtctaggccaccctcacgcccttcccgtggcctactcgacggtcgggccttccgggtctagggaaggtacgtggacggtcctaggtacttagttaacgtggtcgactagaccgtaggttacgggaacttggaaccgacggtacccgttaggaacgtcggtccttaccgttacgtcggttaccgttacgggaaaccggttcggggtaacccgtaacgggttccccgtaacccgggttacccgtaacgggttacccgtacggtaaccccccgg

SEQ ID NO: 17371 - DNA, 438 bp, Homo sapiens
  misc_feature: GYAE6OF02FNY03.34.33.C11.1.454.CMB.1.raw
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
  modified_base (430)..(438): a, c, t, g, unknown or other
  misc_feature (430)..(438): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctctatgtctcggaactgggaccaggtcacgtctaggtcagccaagccaacccntgtcactctcgtcccgccctcctcactcacgtgtactgacgcgggctggcaaggcncatagnnnnnnnnn

SEQ ID NO: 17372 - DNA, 421 bp, Homo sapiens
  misc_feature: GYAE6OF02H86IV.34.33.C11.1.454.CMB.1.raw
  modified_base (358)..(358): a, c, t, g, unknown or other
  misc_feature (358)..(358): n is a, c, g, or t
  modified_base (412)..(412): a, c, t, g, unknown or other
  misc_feature (412)..(412): n is a, c, g, or t
  modified_base (416)..(421): a, c, t, g, unknown or other
  misc_feature (416)..(421): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcagtgggatgacagcctgaatggctcctatgtctcggaactgggaccaaggtcaccgtctaggtcagccaaggcccaacccntgtcactctcgtcccaccctcctcatcacgtgtactgacgcggctggcaaggcnatgnnnnnn

SEQ ID NO: 17373 - DNA, 422 bp, Homo sapiens
  misc_feature: GYAE6OF02G4IXJ.34.33.C11.1.454.CMB.1.raw
  modified_base (413)..(422): a, c, t, g, unknown or other
  misc_feature (413)..(422): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcaccgtctaggtcagcccaaggccaaccccactgcactctcgttccccaccctcctcatcacgtgtactgagcgggctggcaaggcgcatagnnnnnnnnnn

SEQ ID NO: 17374 - DNA, 431 bp, Homo sapiens
  misc_feature: GYAE6OF02IOI50.34.33.C11.1.454.CMB.1.raw
  modified_base (416)..(416): a, c, t, g, unknown or other
  misc_feature (416)..(416): n is a, c, g, or t
  modified_base (421)..(431): a, c, t, g, unknown or other
  misc_feature (421)..(431): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcaccgtctaggtcagcccaaggcccaacccactgtcattctcgttcccaccctcctcatcacgtgtactgagcgggctggcaaggcgnatagnnnnnnnnnnn

SEQ ID NO: 17375 - DNA, 511 bp, Homo sapiens
  misc_feature: GYAE6OF02F7UDQ.34.33.C11.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (458)..(458): a, c, t, g, unknown or other
  misc_feature (458)..(458): n is a, c, g, or t
  modified_base (478)..(478): a, c, t, g, unknown or other
  misc_feature (478)..(478): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctgggacccccgggnagagggtcaccatctcttgtctggaagcagctccaanatcggaagtaatactgtaaactggtttcagcaactcccaggaccgccccaaactcctcatccatagtaataatctgcgccctcgacggggtccctgaccgtattctctcggctccaagtctcggcacctcacgtcctcccgtggcccatcaggtcgggctcccgggtcgaggtatcggagtctgatttattacgtgtgcagcagtggatgacngctggagtggtggtgtcggnggaggacagctgacgtcgagtcagccagctccg

SEQ ID NO: 17376 - DNA, 421 bp, Homo sapiens
  misc_feature: GYAE6OF02HO38C.34.33.C11.1.454.CMB.1.raw
  modified_base (415)..(421): a, c, t, g, unknown or other
  misc_feature (415)..(421): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcagggggtccctgaccgattctctggctccaagtctggcacctcagcctcctggccatcagtgggctccggtctgaggatgaggctgactattactgtgcagcatgggatgacagcctgaatggctcctatgtcttcggaactgggaccaaggtcacgtcctaggtcagcccaaggccaaccccactcgtcactctcgttccccgccctcctcatcacgtgtactgacgcggctggcaaggcgcatagnnnnnnn

SEQ ID NO: 17377 - DNA, 446 bp, Homo sapiens
  misc_feature: GYAE6OF02GI4X9.34.33.C11.1.454.CMB.1.raw
  modified_base (270)..(270): a, c, t, g, unknown or other
  misc_feature (270)..(270): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (435)..(446): a, c, t, g, unknown or other
  misc_feature (435)..(446): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcacgcctccctggccatcagtgggctccggtctgaggntgaggctgactattactgtgcagcatgggatggacagcctagaatggctcctatgtctacggactggaccaaggtccaccgtctaggtcacgccaaggccaacccatcgcactctcgtccccgcctcctcatccacgtntactgacgcggctggcaggcncatgnnnnnnnnnnnn

SEQ ID NO: 17378 - DNA, 457 bp, Homo sapiens
  misc_feature: GYAE6OF02H7S7G.34.33.C11.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (395)..(395): a, c, t, g, unknown or other
  misc_feature (395)..(395): n is a, c, g, or t
  modified_base (420)..(422): a, c, t, g, unknown or other
  misc_feature (420)..(422): n is a, c, g, or t
  modified_base (425)..(457): a, c, t, g, unknown or other
  misc_feature (425)..(457): n is a, c, g, or t
tcagtacacgtgatcacgaccggtgctcgattttagagtgagctcgttggggtttgggggccgtttcctaggaagcagctaccaacatcggaagtaatactgtaaactggtttcagcaactcccaggaacggcccccaaactcctcatccatagtaaataatcagcggccctcaggggtccctgaccgattctctggctccaagtctggcacctcagcctccctggccatcagtgggctcggtctgaggatgaggctgactattacngtgcagcatgggatgacngctgatggctctatgtcttcggaatgggacaaggtcaccgtctaggcagccaaggccaacccatgtcactctcgttcccgcctcctcatcacgttgactggagccgggtntcgggacaaggggcactaagtagcnnnagnnnnnnnnnnnnnnnnnnnnnnnnnnnnnnnnn

SEQ ID NO: 17379 - DNA, 440 bp, Homo sapiens
  misc_feature: GYAE6OF02F50QC.34.33.C11.1.454.CMB.1.raw
  modified_base (424)..(424): a, c, t, g, unknown or other
  misc_feature (424)..(424): n is a, c, g, or t
  modified_base (430)..(440): a, c, t, g, unknown or other
  misc_feature (430)..(440): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaactctgggaacacagccactctgaccatcagcgagacccaggctatggatgacgctgactattactgtcaggcgtgggacaatagcattgtggtattcgggcggagggaccaagctgaccgtcctaggtcagcccaaggctgccccctggtccactctcgttcccgccctcctcatcacgtgtactgagcgggctggcaaggcncatagnnnnnnnnnnn

SEQ ID NO: 17380 - DNA, 544 bp, Homo sapiens
  misc_feature: GYAE6OF02IALGX.34.33.C11.1.454.CMB.1.raw
  modified_base (141)..(141): a, c, t, g, unknown or other
  misc_feature (141)..(141): n is a, c, g, or t
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (516)..(544): a, c, t, g, unknown or other
  misc_feature (516)..(544): n is a, c, g, or t
tcagtacacgtgatcacgaccggtgctcgatttagagtgagctcgttgggttttggggacccccggggccgaggagggtcaccatctcttgttctggaagcagctccaacatcggaagtaatactgtaaactggtttcagnaactccaggaacggccccaaactcctcatccatagtaataatcagcggccctcgaggggtccctgaccgattcnctggctaccaagtctggcacctcagcctcctggccaatcagtcgggtctccgggtctaggaggatgaggctgacttattacngtgcagctatcggggatcgacganccgtagaaattcggccttccttagttcgtcgtttacggaacgtgggggaaccaagggttaccaaccgtccttaagggccacgacccgaaaggcccctaaacccgntcgtacacgtcctcgggtttcccccnccctcctcgtacncgtacgtacgtacgtggacggccggcgtggacgaacggccgtacgatacgnnnnnnnnnnnnnnnnnnnnnnnnnnnnn

SEQ ID NO: 17381 - DNA, 453 bp, Homo sapiens
  misc_feature: GYAE6OF02GPSTT.34.33.C11.1.454.CMB.1.raw
  modified_base (439)..(453): a, c, t, g, unknown or other
  misc_feature (439)..(453): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagccctccctggccatcagtgggctccggtctgaggatgaggctgactattactgtgcagcagtgggatgacagcctgaatggctcctatgtcttcggaactgggaccaaggtcaccgtcgtaggtcacgcccgaaggcccaacccatcgtcacttcctcgttccccgccttccctcactcacgtgtacgtgacggccgggctcggcgaagggcacagtagnnnnnnnnnnnnnnn

SEQ ID NO: 17382 - DNA, 453 bp, Homo sapiens
  misc_feature: GYAE6OF02IRQ7S.34.33.C11.1.454.CMB.1.raw
  modified_base (412)..(412): a, c, t, g, unknown or other
  misc_feature (412)..(412): n is a, c, g, or t
  modified_base (442)..(453): a, c, t, g, unknown or other
  misc_feature (442)..(453): n is a, c, g, or t
tcagtacacgtgatcacgaccggtgctcgatttagagtgagctcgttggggtttgggggacccccgggcagagggtcaccatctcttgttctggaagcagctccaacatcggaagtaatactgtaaactggtttcagcaactcccaggaacggcccccaaactcctcatccatagtaataaatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttggaactgggaccaaggtcaccgtctaggtcagcccaaaggcccaaacccatcgtcactctcgtccccgcctcctcatcacgtntactgagcgggtctggacaaggcacatagnnnnnnnnnnnn

SEQ ID NO: 17383 - DNA, 459 bp, Homo sapiens
  misc_feature: GYAE6OF02GVVIA.34.33.C11.1.454.CMB.1.raw
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (428)..(459): a, c, t, g, unknown or other
  misc_feature (428)..(459): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtggctcgtctgaggntgaggctgactattactgtgcagcatgggatgacagcctgatggctctatgtcttcggaactggaccaaggtcaccgtctaggtcagcccaaggccaacccntgtccactctcgttccccnccctcctcactcacgttcgtactgagcgggtctggacaagggccacgatagcagcnnnnnnnnnnnnnnnnnnnnnnnnnnnnnnnn

SEQ ID NO: 17384 - DNA, 676 bp, Homo sapiens
  misc_feature: GYAE6OF02JAEWH.34.33.C11.1.454.CMB.1.raw
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagccgtctcgggacccccggcagacgggtcaccatctcttgtactggaagcagctccaanancggaacgtaanactgtaaactggtttcagacaactccgaggaaccggacccccaactcccacactacctatagtaanaactcagccgcctcgacggggtcctacgaccgtattcctctggcctaccgaagtctaggacccacgtcacgtcctcccgtcggtacccagtaccgaggtcggccttccggtacgtacgtacggatcggacggaccttgaaccttacttacgtcgtccggtacacgtacgacggttaccgggtaagttaccgaacgtaagtacccgtacggtaacgttcgggtacccttacgttaacgttcggttaacccggtttaaccggtaaacggttaccggggtaacccttaaggggtacccccttaaacccgggttacccgttaccggggttacgaaccccgggtaacccccggg

SEQ ID NO: 17385 - DNA, 431 bp, Homo sapiens
  misc_feature: GYAE6OF02GCK03.34.33.C11.1.454.CMB.1.raw
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (426)..(431): a, c, t, g, unknown or other
  misc_feature (426)..(431): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcactgggctccgggctgaggatgaggctgattattactgtcagtcctttgacagcagcctgagtgcttatgtcttcggactgggaccaggtcacgtctaggtcagccaggccaacccntgtcactctcgtccccacctccncactcacgtgtactgacgcgggctggcaggcncatgnnnnnn

SEQ ID NO: 17386 - DNA, 415 bp, Homo sapiens
  misc_feature: GYAE6OF02F0YFP.34.33.C11.1.454.CMB.1.raw
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
  modified_base (408)..(415): a, c, t, g, unknown or other
  misc_feature (408)..(415): n is a, c, g, or t
tcagtacacgtgatcacgaccggtgctcgatttagagtgagctcgttgggtttgggggccgttcctggaagcagctccaacatcggaagtaatactgtaaactggtttcagcaactcccaggaacggcccccaaactcctcatccatagtaataatcagcggccctcgaggggtccctgaccgattctctggctccaagtctggcacctcagcctccctggccatcactgggcctccgggctgaggatgaggctgattattactgtcagtcctttgacagcagcctgagtgcttatgtcttcggactgggacaggtcaccgtcctaggtcacgcccaaggcccaaccccntcgcactctcgttccccacctctcatcacgtntactgagcggctggcaggccnatagnnnnnnnn

SEQ ID NO: 17387 - DNA, 587 bp, Homo sapiens
  misc_feature: GYAE6OF02F4CRM.34.33.C11.1.454.CMB.1.raw
  modified_base (525)..(525): a, c, t, g, unknown or other
  misc_feature (525)..(525): n is a, c, g, or t
  modified_base (536)..(536): a, c, t, g, unknown or other
  misc_feature (536)..(536): n is a, c, g, or t
tcagtacacgtgatcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaaccaccaagtacaggaatattaacctgtttcccatcgactacgcctttcggcctcgccttaggggtcactcaccctgccccgattaaccgttggacaggaacccttggtccttccggcgagccgggtcttttcgaccctctttatcgttacttatgtcagctattcgcactttctgactaccctccagccatcgcctcacacgcacctaccttcacacggacttaacagaaccgccctacccctacccaaacaaccgcagtaacgcgtcgctcgccncacgcgttcgnctagtcgttacgcccgttacacttcctccgcgcgacggccgactcgtaccg

SEQ ID NO: 17388 - DNA, 600 bp, Homo sapiens
  misc_feature: GYAE6OF02GYGAX.34.33.C11.1.454.CMB.1.raw
  modified_base (517)..(517): a, c, t, g, unknown or other
  misc_feature (517)..(517): n is a, c, g, or t
  modified_base (519)..(521): a, c, t, g, unknown or other
  misc_feature (519)..(521): n is a, c, g, or t
  modified_base (525)..(526): a, c, t, g, unknown or other
  misc_feature (525)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (595)..(595): a, c, t, g, unknown or other
  misc_feature (595)..(595): n is a, c, g, or t
tcagtacacgtgatcacgaccggtgctcgattttagagtgagctcgttggggtttgggggccgttccgtggaagcagctccaacatcggaaggtaatactgtaaactggtttcagcaacctcccaggaacgccccaaacctcctcattccatagtaataatcagtcggccctcacggggtccctgaccgattctctggctccaagtctggcactcacgccgtccctggccatcagtgggcttccggtctggaggtatggaggtctagaactattactgtgtcagcagtgggatggacacgccgtagaatcggctcctagtcgtacgttacgggaacgtggggaacctaacgggtccaacccggttccgtacgggtaccgtaccggaccccgaaacgggacccctaacccctcgttacgtacctaaccttccgttccgtttcccccggcccttaccgtactaacgtccaacttaccgtgggacgtcgggtacgtcgggacgacggcggacgaagtagngnnntatnntnacnanncngngtgnngngtgtangagngtagngtgctgtgtgacactgtcgcgaccgtgcgtacgtntaccg

SEQ ID NO: 17389 - DNA, 447 bp, Homo sapiens
  misc_feature: GYAE6OF02H020L.34.33.C11.1.454.CMB.1.raw
  modified_base (427)..(427): a, c, t, g, unknown or other
  misc_feature (427)..(427): n is a, c, g, or t
  modified_base (434)..(447): a, c, t, g, unknown or other
  misc_feature (434)..(447): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcagtgggatgacagctagaatggctctatgtcttcggactggaccaaggtcaccgttctaggtcacgcccgaacggcccaaccccactcgtaccactctcgttccccgccctcctcatccacgtgtactgacggcgggtctgggcacggcncagtagnnnnnnnnnnnnnn

SEQ ID NO: 17390 - DNA, 445 bp, Homo sapiens
  misc_feature: GYAE6OF02GMPRI.34.33.C11.1.454.CMB.1.raw
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (438)..(445): a, c, t, g, unknown or other
  misc_feature (438)..(445): n is a, c, g, or t
tcagtacacgtgatcacgaccggtgctcgatttagagtgagctcgttgggtttgggggacccccgggcagagggtcaccatctcttgttctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgaggatgaggctgactattactgtgcagcagtgggatgacagcctgaatggctcctatgtcttcggaactgggaccaaggtcaccgtcctaggtcagcccaaggcccaacccactcgtcactctcgttccccnccctcctcatcacgtntactgagcggctggcaggcncatgnnnnnnnn

SEQ ID NO: 17391 - DNA, 475 bp, Homo sapiens
  misc_feature: GYAE6OF02GDC98.34.33.C11.1.454.CMB.1.raw
  modified_base (425)..(425): a, c, t, g, unknown or other
  misc_feature (425)..(425): n is a, c, g, or t
  modified_base (456)..(475): a, c, t, g, unknown or other
  misc_feature (456)..(475): n is a, c, g, or t
tcagtacacgtgatcacgaccggtgctcgatttagagtgagctcgttgggtttggggacccccgggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgagctgactatactgtgcagcatgggatgacagcctgaatggctcctattcgtcttcggaacgtcgggaaccaaggtccaccgtcctaggtccacgcccaaggcccaacccgctcgcacttctccgttccccgccctcctcatccacgtcgtacngacgccgggtctggacacggcgacagtacgnnnnnnnnnnnnnnnnnnnn

SEQ ID NO: 17392 - DNA, 541 bp, Homo sapiens
  misc_feature: GYAE6OF02IGSY2.34.33.C11.1.454.CMB.1.raw
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(516): a, c, t, g, unknown or other
  misc_feature (512)..(516): n is a, c, g, or t
  modified_base (518)..(522): a, c, t, g, unknown or other
  misc_feature (518)..(522): n is a, c, g, or t
  modified_base (524)..(526): a, c, t, g, unknown or other
  misc_feature (524)..(526): n is a, c, g, or t
  modified_base (528)..(541): a, c, t, g, unknown or other
  misc_feature (528)..(541): n is a, c, g, or t
tcagtacacgtgatcacgaccggtgctcgatttagagtgagctcgttggggtttggggacccccggggcagagggtcaccatctcttgttctggaagcagctccaacatcggaagtaatactgtaaactggtttcagcaactcccaggaacggcccccaaactcctcatctatgctaacaccaatcggccctcaggggtccctgaccgattctctggctccaagtctggcacctcagccctccctggccatcactgggctccgggctggaggatggaggctagtatttattactgtcacgttcctttgacagcagcctggagtgcttatcgtcttcgggaactgggaccaacggtcaccgtctaggtcagcccaacggcccaaacccgtctacgtccactccttcgttcccccgcccttccctacgacttaccgacggttcgtaacgtggtacggccggggtacgtcgggacgaacggggtaccgacgaacgttaaggnagcagtacncncnnnnngnnnnncnnngnnnnnnnnnnnnnn

SEQ ID NO: 17393 - DNA, 614 bp, Homo sapiens
  misc_feature: GYAE6OF02JM9H7.34.33.C11.1.454.CMB.1.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
  modified_base (522)..(522): a, c, t, g, unknown or other
  misc_feature (522)..(522): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (576)..(576): a, c, t, g, unknown or other
  misc_feature (576)..(576): n is a, c, g, or t
  modified_base (582)..(583): a, c, t, g, unknown or other
  misc_feature (582)..(583): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
tcagtacacgtgatcacgaccggtgctcgatttagagtgagctcgttgggtttggggtacccccgggccgacgagggtcgaccatctcttgttctggaagcagctccaacatcggaagtaatactgtaaactggtttcagcaactccaggaacggcccccaaactcctcatccatagtaataatcagcggccctnacggggtccctgaccgattcctcgttggcttccaagtctggcctacctcacgccttcccgtggccatcagtcggcctaccggtntcgaggactggtacggactgaaccttatttaccgtgtcgcagcaggtggggtatggaccgagtcccgtaggaactcgggtaccttccgtaagttcgtacgtttcgggaaacttcggggaacctagggtccaccggttctaggtccagtcctaacggaccctaaccctgtcgtactcctcggtccgtttccccacccttccgtacactccgtacgttacgtaactcggtaacggccggtacccngggtaaccgtacgcggtacctagtacacgtntacngtacncgctagactgcacngtctcnngtcncngngtcgtgcgcgcgngcgtgcnctc

SEQ ID NO: 17394 - DNA, 606 bp, Homo sapiens
  misc_feature: GYAE6OF02IO4X7.34.33.C11.1.454.CMB.1.raw
  modified_base (295)..(295): a, c, t, g, unknown or other
  misc_feature (295)..(295): n is a, c, g, or t
  modified_base (501)..(501): a, c, t, g, unknown or other
  misc_feature (501)..(501): n is a, c, g, or t
  modified_base (583)..(606): a, c, t, g, unknown or other
  misc_feature (583)..(606): n is a, c, g, or t
tcagtacacgtgatcacgaccggtgctcgatttagagtgagctcgttgggtttgggggaccccccgggcagagggtcaccatctcttgttctggaagcagctccaacatcggaagtaatactgtaaactggtttcagcaactcccaggaacggcccccaaactcctcatccatagtaataatcagcggccctcgacggggtcccttgaccgattctctggcctccaagtctggcacctcagccctccctggccatcagtcgggcctccggtctggagatgaggctgactattacngtgcagctagtggatgacaggtcctaggaagtcggaccttaccgtattcggttaccgttacgggtaaccgttggggaaccctaacggttcccacccggttaccgtagggttaccaaccggaccccgaaaccggtacccccaaaccccgtacgtaccgtacccttaaccgtttcccgttaccgtttccccccgtcccttcccccgtntaaaccttcccgaacggttcgttaacccgtgggaaccgggtccgggtaccgtcgggaccggttaaacggccgactaagtgcnnnnnnnnnnnnnnnnnnnnnnnn

SEQ ID NO: 17395 - DNA, 861 bp, Homo sapiens
  misc_feature: GYAE6OF02JPQXQ.34.33.C11.1.454.CMB.1.raw
  modified_base (217)..(217): a, c, t, g, unknown or other
  misc_feature (217)..(217): n is a, c, g, or t
  modified_base (484)..(484): a, c, t, g, unknown or other
  misc_feature (484)..(484): n is a, c, g, or t
  modified_base (648)..(648): a, c, t, g, unknown or other
  misc_feature (648)..(648): n is a, c, g, or t
tcagtacacgtgatcacgaccggtgctcgatttagagtgagctcgttgggttttggggtcgagcttcagctgtgggttgagaagacaggactcaggacagtctccagcatggccagcttccctctcctctcaccctcctcactcactgtgcgagggtcgtcggcccagtctgtgctgactcagcccaccctcacgcgtcgtccggggaccccccggngacggacgggtaccacctacttccttcctttcgttacgtacgggaacgcgtaacgtcctacccaaactaagttaccgggaaaagttaaacgtaaccgttaaggttaaaaccgttggggttttaccaacggacctaaaccctcccggtaaaccggggaaaccccggtaacccccccaaaaccttcccgtacctaaccttaccggtaacttaaacgtaaaacttactaccaacggtccccggtacccttacggaccggggttttacccncggaacccgttagttaccctttcggtccggtacccttacccgtaaacggtttcccggtacggcccttaaacccgtccgtacccggttcccctttccccgtacgggacccctaacttaccgggtaacgggtccgggttccctaccgggttaccgtgggtaaaggngttaccggaagggttcctacgttaactttaccgttacgtcggttcggaaccgtacggtcgttaacgggtagaacgtttccgggactaaccgggtccgttaacgtaggttcccggtaccgttaaccgttggttaaacccgttggttaacccgggtaacgtacgggaacccgtacggttccgtacccgttaccgagggtccccaaggtcccccgg

SEQ ID NO: 17396 - DNA, 610 bp, Homo sapiens
  misc_feature: GYAE6OF02IG775.34.33.C11.1.454.CMB.1.raw
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtgggcccagtctgtgctgactcagccaccctcagcgtctcgggacccccgggcagagggtcaccatctcttgttctggaagcagctaccaacatcggaagtaatactgtaaactggttcagcaactcccaggaaccggccccaaactcctacactccatagtaaataatcacgccgccctcgacgggtccctagaccgattctctcggctaccgaagtcgtgccacctcacgccctccgtcgcctactcgacggtcgggccttccggttctacggaggtatgggacgtccgtagtacttaattacgttgtacgcacggtacaggtagggatacggaccgtacgtccgtagtaacgtcgtaccttaccttacgtcggttaccggttacggaaccggttacggaacccgtacggtaccgtacccggttaccggtaacggtccgtacggaaccccgg

SEQ ID NO: 17397 - DNA, 726 bp, Homo sapiens
  misc_feature: GYAE6OF02JC5H8.34.33.C11.1.454.CMB.1.raw
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
  modified_base (695)..(695): a, c, t, g, unknown or other
  misc_feature (695)..(695): n is a, c, g, or t
  modified_base (702)..(702): a, c, t, g, unknown or other
  misc_feature (702)..(702): n is a, c, g, or t
  modified_base (705)..(709): a, c, t, g, unknown or other
  misc_feature (705)..(709): n is a, c, g, or t
  modified_base (711)..(726): a, c, t, g, unknown or other
  misc_feature (711)..(726): n is a, c, g, or t
tcagtacacgtgatcacgaccggtgctcgatttagagtgagctcgttgggtttggggtacccccgggcgagagggtcaccatctcttgttctggaagcagctccaacatcggaagtaatactgtaaactggtttcagcaactccgaggaacggcccccaaactcctcatccatagtaataatcagcggccctcgacgggggtccctggaccgatttcctcgtggcctccaagttcctggcctacctgacgcccttcccctgggacccatcacggcgggtccttcccgggtctagggaggacgtggaggcctaggtacctatttacgtgtcgacaggctaggtggggtaatggaccacggcctaggtaaaggtcggccttccttaacgttccgggttccgttttacccggtaaaacgggttccgggggaaacccgaaccggggtttaccgaaccccggtttacccggtaaacgggggttaccctaccgggaaccccccgtttaaaagggtacccccccaaaacccccgtaccggtttacgtttacccctaaccttcccggtttacccggttttccccccggtcccccttcccgtaacccttaacctccgttaaacgtccgtttaccgtacgggtaccgggcgggtaccccggttagggaccgaacggggttccgacgtacgttcgacnggtnaagntcgctgncgnnnnncnnnnnnnnnnnnnnnn

SEQ ID NO: 17398 - DNA, 475 bp, Homo sapiens
  misc_feature: GYAE6OF02HK634.34.33.C11.1.454.CMB.1.raw
  modified_base (396)..(396): a, c, t, g, unknown or other
  misc_feature (396)..(396): n is a, c, g, or t
  modified_base (459)..(475): a, c, t, g, unknown or other
  misc_feature (459)..(475): n is a, c, g, or t
tcagtacacgtgatcacgaccggtgctcgatttagagtgagctcgttgggtttgagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcacgccctccctggccatcagtgggctccggtctgaggatgagctgactattactgtgcagcagtgggatgacagcctagatcggctcctatgttcttcggacgtggaccaggtccaccgtcgtacgtcacgacccaaggcctccgcccccgtcggtccaccttccgttccgttccccncccgttcctctactccgacgttcgtacgtcggcggtccggtcgtcggacgacggcgcagtagnnnnnnnnnnnnnnnnn

SEQ ID NO: 17399 - DNA, 487 bp, Homo sapiens
  misc_feature: GYAE6OF02GQDFU.34.33.C11.1.454.CMB.1.raw
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (466)..(487): a, c, t, g, unknown or other
  misc_feature (466)..(487): n is a, c, g, or t
tcagtacacgtgatcacgaccggtgctcgatttagagtgagctcgttgggtttgggggccgttcctggaagcagctccaacatcggggcaggttatgatgtacactggtacaagcagcttccaggaacagccccccaaactcctcatctatgctaacaccaatccggccctcaggggtccctgaccgattctctggctccaagtctggcacctcacgccctcccgtggccatccacgtgggcctccgggctgaggatggaggctagaattattactgtcagttccctttgacagcacgcctagagtgtcttagtcgtccgtttacggaactggggaacctaagggtccacccggttctaggtcgacgcccaaggacccaaccccacgtgtccactctacgtccccgcccctctcactaccacgtgtacctagacggcggcgtggacgaggccncgaatcgnancgnnnnnnnnnnnnnnnnnnnnnn

SEQ ID NO: 17400 - DNA, 671 bp, Homo sapiens
  misc_feature: GYAE6OF02ICYPK.34.33.C11.1.454.CMB.1.raw
  modified_base (166)..(166): a, c, t, g, unknown or other
  misc_feature (166)..(166): n is a, c, g, or t
  modified_base (213)..(213): a, c, t, g, unknown or other
  misc_feature (213)..(213): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcagggtcgtcgggacccngtctgtgctgctcagcccacctcacgtcgtcctcggggacccccggnaggacgggtcacctatcctcttgttccaggaagcagctaccgaacactacggtaagtaactactagttaaaacgttggttcaacgacaaccaccgaagggaacccgaccccctaaatcctacacttacaattaagaaacttaacncgaacgcggtccccttaggaccggggttccagtaaccgctttacncgttcggacctacgaagttcncgacctccgacacccggtcccttacgtccgaccacgtcgtagggtccgtgttccggtctagggacgtagtgacgtccgattacgttaattcgttcncgttactcggtttanaccganccgtctaccgtgtacgttcgttacttacgttcgttaacgtaccggtaaacggtacgggtaaccgttaacgtccgttacccgttacggtaccggtacccgtaccgaacccgtacccgtaaccccgaacccg

SEQ ID NO: 17401 - DNA, 535 bp, Homo sapiens
  misc_feature: GYAE6OF02JG1DW.34.33.C11.1.454.CMB.1.raw
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (522)..(523): a, c, t, g, unknown or other
  misc_feature (522)..(523): n is a, c, g, or t
  modified_base (530)..(530): a, c, t, g, unknown or other
  misc_feature (530)..(530): n is a, c, g, or t
  modified_base (533)..(534): a, c, t, g, unknown or other
  misc_feature (533)..(534): n is a, c, g, or t
tcagtacacgtgatcacgaccggtgctcgatttagagtgagctcgttgggtttgggggacccccgggcagagggtcaccatctcttgttctggaagcagctccaacatcggaagtaatactgtaaactggtttcagcaactcccaggaacggccccaaactcctcatccatagtaataatcagcggccctcaggggtccctgaccgattctctcggctccaagtctggcacctcagcctcctgccatcagtcgggcctaccggtcgtgagatgaggctgactattacgtgtgcagcagtggatcganacgctgagtcgtctctatgtcgtacggactcgggacaggtccaccgtctagtcacgacccgacgacccaacctgtcgtaccnccttctaccgtccccgccnctcactcgacgtcggtacncggacggtccgggactaggggcccaacgggtccacgacgtagtgcctgcacgntacncncnctcgtcncgacgcgtcgcacgtcncngcgntagnngctcgtncgnng

SEQ ID NO: 17402 - DNA, 936 bp, Homo sapiens
  misc_feature: GYAE6OF02HMR5L.34.33.C11.1.454.CMB.1.raw
  modified_base (219)..(219): a, c, t, g, unknown or other
  misc_feature (219)..(219): n is a, c, g, or t
  modified_base (626)..(626): a, c, t, g, unknown or other
  misc_feature (626)..(626): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcgagggtcgtgggcccagtctgtgctgactcacgcccaaccctcgagtccgtccgtcggggaccccccggngaggacgggtccaccgacttctcgtttggttcgtaggaacgcactcctaccaacagtacggaacgtaaattaacgtacgttaaaacttcgggtttacaacggtcctaaaccgttccccgaacggtaaaccccgggaacccccaaaaccgtccccttacaacctaccgtaagttaaacgtaaacttaaacgtacccgtaacgggcccggtaccccgttacggtaaccgggggttaccccctacgggttaaccccggttagttttcccgtacgttaccgggttaccgttaaccccggtaaacggttcccggttacggacccctaccgttacccgaaccgttcccctaaccccggttcgggaccctaaacgtcggtaccggggttacggggtccccgttacccggggttntaacgggtacgggtaacgtttaccggggaccgttacggttaacggtaaccgtttaaccgtttaacgggtccgggtaacgttacccgaacggtacggttaacggttacgggggtaactacgggttaaacccgtaaccggtccggttaaggttaaacccgggttccgttacccgtttaccgtttagtttcccggggtcccgttttaaaccggggaacccgggtttaaccggggaaccccgttaacggggttacccggttacccggggtttaaccgtacccgggtttaccccgaaccccggtaacccccgggg

SEQ ID NO: 17403 - DNA, 767 bp, Homo sapiens
  misc_feature: GYAE6OF02GGTRM.34.33.C11.1.454.CMB.1.raw
  modified_base (216)..(216): a, c, t, g, unknown or other
  misc_feature (216)..(216): n is a, c, g, or t
tcagtacacgtgatcacgaccggtgctcgatttagagtgagctcgttgggtttggggcagcttcagctgtgggttgagaagacaggactcaggacagtctccagcatggccagcttccctctcctcctcaccctcctcactcactgtgcgaggggtcgtgggcccagtctgtgctgactcgacgcccacctcgagcgtccgtcggggacccccggnaaggagggtccaaccatccttcttcgttctgggaacgcacgacctaccaaacagtacggaaattaatactagtaaacgtttggttcagacaactcccgaggaacccggaccccaaactcctactacgacaactagtaaactaactccgacgccgtaccctcggacgggtcctacgaccgtacgttcctcgttcggtacctaccgtaaacttccggtacggacctacccgtaccgaccggtaccccttcccgtaccgggtacccaacgttccgggtaagggttccggggtcccgttacccgggttacggtacgggaacgggttacgtcgggtaacggttacgttacggttaacgttaacttttaacggttccgtaccggtaacgtacggtaaccggtagggttacgggaaggtaccggtaacgacggtcctaaggtaacggttccggtaccgttacgtacggtttccggttacggttaaccggtaacggtaccgggaacggtaacggttacccgtaccggttaccgttacgggttacccacggaaccccggg

SEQ ID NO: 17404 - DNA, 573 bp, Homo sapiens
  misc_feature: GYAE6OF02FVKC4.34.33.C11.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (505)..(505): a, c, t, g, unknown or other
  misc_feature (505)..(505): n is a, c, g, or t
tcagtacacgtgatcacgaccggtgctcgatttagagtgagctcgttggggtttgggggccgttcctggaagcagctccaacatcggaagtaatactgtaaactggtttcagcaactcccaggaacggccccaaactcctcatccatagtaataatcagcggccctcaggggtccctgaccgattctctggctccaagtctggcacctcagcctccctggccatcagtgggctccggtctgagntgaggctgactattactgtgcagcaagtgggatgacngcctgaatgctctatcgtcttcggaactcggaaccaaggtccaacccggtcgtacggtcacggtacccaaggccctaacccatggtaccacgttcctccgtttccccgacccttacctcaacttccgacgttacgtactcggacgtccgggctcggacgaacggccgacaacgtagatcgancttgatnacgaancgtancgactatacgctacgagtcacgtnacgtacgtacgtcagtacgtacgtacgtacgtactacgtcgtacgtacgaccgtagacgacgtagtac

SEQ ID NO: 17405 - DNA, 290 bp, Homo sapiens
  misc_feature: GYAE6OF02JHZ9F.34.33.C11.1.454.CMB.1.raw
  modified_base (155)..(155): a, c, t, g, unknown or other
  misc_feature (155)..(155): n is a, c, g, or t
  modified_base (165)..(165): a, c, t, g, unknown or other
  misc_feature (165)..(165): n is a, c, g, or t
  modified_base (174)..(174): a, c, t, g, unknown or other
  misc_feature (174)..(174): n is a, c, g, or t
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (260)..(290): a, c, t, g, unknown or other
  misc_feature (260)..(290): n is a, c, g, or t
tcagtacacgtgatcacgaccggtgctcgatttagagtgagctcgttgggtttggggcagcttcagctgtgggttgagaagacaggactcaggacagtctccagcatggccagcttcccctctcctactcacctcctcactcactgtgcaggtcngggccagtcngtgctgctnagccacctcgagcgtctcgggacccggcagaggtcaccatctcttgtactaggaagctacnctcaagctacgagtanactgtaaannnnnnnnnnnnnnnnnnnnnnnnnnnnnnn

SEQ ID NO: 17406 - DNA, 207 bp, Homo sapiens
  misc_feature: GYAE6OF02GUTQA.34.33.C11.1.454.CMB.1.raw
  modified_base (195)..(207): a, c, t, g, unknown or other
  misc_feature (195)..(207): n is a, c, g, or t
tcagtacacgtgatcacgaccggtgctcgatttagagtgagctcgttgggtttgggtcagcctccaccaagggcccatcggtcttccccctggcaccctcctccaagagcaactctgggggcacagcggccctgggctgcctggtcaaggactacttccatcacgtgtactgagcggctggcaaggcgcagtagnnnnnnnnnnnnn

SEQ ID NO: 17407 - DNA, 687 bp, Homo sapiens
  misc_feature: GYAE6OF02J0ESG.34.33.C11.1.454.CMB.1.raw
  modified_base (150)..(150): a, c, t, g, unknown or other
  misc_feature (150)..(150): n is a, c, g, or t
  modified_base (152)..(152): a, c, t, g, unknown or other
  misc_feature (152)..(152): n is a, c, g, or t
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
  modified_base (634)..(634): a, c, t, g, unknown or other
  misc_feature (634)..(634): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (674)..(675): a, c, t, g, unknown or other
  misc_feature (674)..(675): n is a, c, g, or t
  modified_base (677)..(677): a, c, t, g, unknown or other
  misc_feature (677)..(677): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
tcagtacacgtgatcacgaccggtgctcgatttagagtgagctcgttgggtttgagggtcaccatctcttgttctggaagcagctccaacatcggaagtaatactgtaaactggtttacagcaactcccaggaaccggccccaaactccncntccatagtaatatcagcggccctcgagggtccctaggaccattcnctggactccaaggtctcggcacctcacgcctcctggacatcaggtgggcctccgttcnggaaggcgtgtagctagacttattacngtgcgagtcgtagtacggggtatacggacacggtacctaggtaacgtgtaccggttaccttaagtacggttccgttaaacggggtaaccgtaccgggggaaaccgttaaccggtacccttaaccgggtaccgtttaaggggacccttaaacccgggacccggtaaacccggtacccccgtaaaccccctaacggtacccgttaccacccggtttccttaacccggtcccccttaccctacctacgtaccgaccggtttaacccgtggttaacccttagggggaccggtcggaaacccgggttaggacccgaaggttcccaagggttaccaggactggcctaaggtcaacggncacnacgngcgcgacgtcncncgacgacgagncngngacnncncanncncanc

SEQ ID NO: 17408 - DNA, 741 bp, Homo sapiens
  misc_feature: GYAE6OF02JXB9I.34.33.C11.1.454.CMB.1.raw
  modified_base (181)..(181): a, c, t, g, unknown or other
  misc_feature (181)..(181): n is a, c, g, or t
  modified_base (711)..(711): a, c, t, g, unknown or other
  misc_feature (711)..(711): n is a, c, g, or t
tcagtacacgtgatcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccgccaacatacgccttcctcccgtcccccttcgcacgtaacaccaagtacagaatacttaacctgttacccatcgactaccgcctttacggcctcgccgttagggtcgactccacccgtcgaccccgtattaacggttgaccgtaacggtaacccttggtaccttccgggacgtacggcgggtccttttacccgaacccgtcgttttaacttccggttaactttatcgttcacgacttacgttcgacctactttcgtacgtaacttaccccgttaccagtcgtaactccgtaaccctctaacgaccgtaccctaacctacccttcaacgacgttcttaaacccgaggtacccgtaccccttacccccgtaaacccaaaccgtaaccgaacctaacgttaaccgtccgttaccgccgttacggccaccgtacgtcgttacgtccgtacgtacgttaccggttaccgtacccgttacaacgttcccgttcccgggaccncggtaacccggccttaccggtcccgaacgg

SEQ ID NO: 17409 - DNA, 735 bp, Homo sapiens
  misc_feature: GYAE6OF02FNO2E.34.33.C11.1.454.CMB.1.raw
  modified_base (311)..(311): a, c, t, g, unknown or other
  misc_feature (311)..(311): n is a, c, g, or t
  modified_base (669)..(669): a, c, t, g, unknown or other
  misc_feature (669)..(669): n is a, c, g, or t
  modified_base (677)..(677): a, c, t, g, unknown or other
  misc_feature (677)..(677): n is a, c, g, or t
  modified_base (679)..(680): a, c, t, g, unknown or other
  misc_feature (679)..(680): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
tcagtacacgtgatcacgaccggtgctcgatttagagtgagctcgttgggtttgggggccggttcctggaagcagctccaacatcggaagtaatactgtaaactggtttcagcaactcccaggaaccgcccccaaactcctcatccatagtaataatcagccggccctcgagggtccctcgaccgtattctctggcctaccagtctcggcacctcacgtccctccgtcgccatcgaggttcgggccgttccggtctggacggagtcggacggtcttacggacctttaacttacgttggtagaccgacgtanaacggtacggggtactacgaaacgccggtacctaggaacgttcggtctttaccgttaggttccggttaccggttaaccgggtaaccggttaccggggaacccgttaaacggttacccgttaccggtacccggttacggtaacccgacggtaacccccggaaacccggacccctaaaccccgtacctttccgggtaaccctttccccgtttaccggttacccgtttcccccctacccctttaccgaccctttaaacggtcccttaaccggttcgtaaccgggtcggggtaccggtccggggtaccgttcggggaaccgacccgggtacggaccgtagtaacgcggagcttaggctagtnaccgtacngnngncacntcgtacncnctgtgntcgctgntcgactgcncacgcgcactcgngtntc

SEQ ID NO: 17410 - DNA, 567 bp, Homo sapiens
  misc_feature: GYAE6OF01DHY9U.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacgggccggggggtcctgagactctcatgtgcgagggtctggattcaacttttacgattatggcatgacctgggtccgccaagcctccgaaggggaaggggcgtggaggtgggtctcgtggtctagattggaatggtagatagtatagattatgcaggctgtggtggagggcctattcaccatctccagacgacaacgacaaagacctccctgtttcagacaatggactaagtttgaagagaaggaagacgacggtcttaattatttctggtgacgagacgcccgtggacaacggaagttcgtacggtacttaacgttacttaattagttgggtaacg

SEQ ID NO: 17411 - DNA, 656 bp, Homo sapiens
  misc_feature: GYAE6OF01CB4O7.12.33.C11.1.454.CMB.1.raw
  modified_base (471)..(471): a, c, t, g, unknown or other
  misc_feature (471)..(471): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttcctgttgctattttaaaaggtgtccactgtgaggtgcaactggtggaggtcggggggaggtggtaggtacgggccggggggtccctgagactctcatgtgcagggtctggattctaacttttacgattatggcatcgaccgtgggtccgccaagcctccgaggggaaggggctggagtgggtctcgtaggtctgaagttggaatggtagatagtaatagattatgcgaggtctcgtggtggaggggccgtagttccgacctatcctccgagacgaacaaccgccaaacgtaacctcccgttgtttacngtacctaaagtcggaactaagttttaggaaggtaaggtaagggaaacgtaaccgaaccgggtacctttaagttactttaccgtggttacgacccggtaggtaccggccccgttagggacctaaggtaaacggttccgtacgggtaacctttaaccgtaacctttaagttaggttcgggttaacgg

SEQ ID NO: 17412 - DNA, 524 bp, Homo sapiens
  misc_feature: GYAE6OF01BPD67.12.33.C11.1.454.CMB.1.raw
  modified_base (509)..(511): a, c, t, g, unknown or other
  misc_feature (509)..(511): n is a, c, g, or t
  modified_base (513)..(514): a, c, t, g, unknown or other
  misc_feature (513)..(514): n is a, c, g, or t
  modified_base (517)..(520): a, c, t, g, unknown or other
  misc_feature (517)..(520): n is a, c, g, or t
  modified_base (522)..(524): a, c, t, g, unknown or other
  misc_feature (522)..(524): n is a, c, g, or t
tcagatacgacgtacacgaccggtgctcgatttagagtgagctcgttggttcgtgggattcaacttttacgattatggcatgacctgggtccgccaagctccagggaaggggcctggagtgggtctcctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtcgtgggccaagggaccacggtcatcgtctcctcacgcctccaccaagggcccagtccggtcttcccctggccaccctcctaccaagacgcacctcgtcgggggcaccgagcggccctgggcctgccctggcaaggactaccttctaacgtcgtactctggacgcggcgtcggcaaggccgctagtacgnnncnngcnnnncnnn

SEQ ID NO: 17413 - DNA, 522 bp, Homo sapiens
  misc_feature: GYAE6OF01B0XPG.12.33.C11.1.454.CMB.1.raw
  modified_base (249)..(249): a, c, t, g, unknown or other
  misc_feature (249)..(249): n is a, c, g, or t
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagatacgacgtacacgaccggtgctcgatttagagtgagctcgttgggtttggggagagagaaatacattccctccaggcaaatctatgctgcgctggtctgacctgggaccctggggacattgcccctgtgctgagttactaagatgagccagccctgcagctgtgctcagcctgccccatgccctgctgattgatttgcatgttccagagcacacgcctcctgccctgtaagttacttttttagngggtctggtccgcaccctggtgcgaggagtcagtctcagtcaggacacgagcatggacagtggacgggtccccntcagctccgtgggctcctgctactcgtggcctcggaggtcgcctagattgngacatccgagactcgaccctgttccctcccttccctccctgtcctgctatccgtggcgancagtccgtacactntctacgttcggtacggacaagtcaagtacttattaactaatttaattaagttgtatacagcgaaacgaaaccgg

SEQ ID NO: 17414 - DNA, 685 bp, Homo sapiens
  misc_feature: GYAE6OF01DQJF1.12.33.C11.1.454.CMB.1.raw
  modified_base (311)..(311): a, c, t, g, unknown or other
  misc_feature (311)..(311): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggaggtcggggggaggtgtaggtacgggccggggggtcctgagactctcatgtgcgagggtctggattctaacttttacgattatggcagtgacctgggtccncaagctccgagggaggggctggaggtgggtctcgtggtctagaattggaatggtgattagtatagtattagtgacgaggtctcgtggtggacggggtccgtagtttaccgacctactccgtaccgagtaacgaaccgaaaccgaccaaacgtaacccttcccttacgtttacctacgtactaaagtcggtaaacttaagtttaggaaggtaaggaagggaaacgtaaccgtaaccgggttacctttaagtttacgtttcgttaggttacggaccggaacggtaccggtccccgttacgggaccgaaacggtaaccgttacgttaacgggtaaccttaaacttaaccgtttaatttaaggttagggtttaacggg

SEQ ID NO: 17415 - DNA, 622 bp, Homo sapiens
  misc_feature: GYAE6OF01CGW5F.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggaggtcggggggaggtgtaggtacgggccggggggtcctgagactctcatgtgcgagggtctggattacaacttttacgattatggcatgacctgggtcccgccaagcctccgaggggagggcgtggaggtgggtctcgtgggtctagtaagttggaagtggtagtatagtatagattatgcaggtctcgtggtggacggggcctattccgacctatcctaccaagacgaacaaccgaccaaacgacccttccttgtttcacgactaagtacgaacttaattggaagaggtaagggaacgacgtaccggttactttagtttactttcgtggtcgaccggtaaggccgtcccccgtgggacaaggtacgttcgtaacggtaactttacgtaattatttaacgtggttaaccggg

SEQ ID NO: 17416 - DNA, 583 bp, Homo sapiens
  misc_feature: GYAE6OF01CUI34.12.33.C11.1.454.CMB.1.raw
  modified_base (567)..(568): a, c, t, g, unknown or other
  misc_feature (567)..(568): n is a, c, g, or t
  modified_base (575)..(575): a, c, t, g, unknown or other
  misc_feature (575)..(575): n is a, c, g, or t
  modified_base (577)..(583): a, c, t, g, unknown or other
  misc_feature (577)..(583): n is a, c, g, or t
tcagatacgacgtacacgaccggtgctcgatttagagtgagctcgttgggtctggattcaacttttacgattatggcatgacctgggtccgccaaagctccagggaaggggctggagtgggtctctggtctgaattggaatggtgatagtatagattatgcaggctctgtgaggggccgattcaccatctccagagacaacgccaagaactccctgtttctgacaaatggacatttgagagaggaagacacggccttatatttctgtgcgagagccctcggcagaagtctggactactactattatggtatggacgtcgtggggccaagggaccacggtcatcgtctcctcagccctccaccgaacggcccagttccggtccttcccccgtcggccctacccctccctaccaacggacgcccaccgtcggtcgggggccacgacggccggcccgtcgggctcggccgtcggtacgaacggtaccttaccgttacccgttacggtccgttaactccgtaggtacgggtccgggccgtcgggaccgaacgggtccgaccgaagtacgtnntgcgcgncnnnnnnn

SEQ ID NO: 17417 - DNA, 573 bp, Homo sapiens
  misc_feature: GYAE6OF01BTTSZ.12.33.C11.1.454.CMB.1.raw
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (400)..(400): a, c, t, g, unknown or other
  misc_feature (400)..(400): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcgggggagtgtagtacggccggggggtccctgagactctcatgtgcagggtctggattcaacttttacgattanggcatgacctggtccnccaagctccgagggagggctggagtgggtctcgtggtctgaattggaatggtnatagtatagattatgcaggctcgtgtgaggggccattcacatcnccaagacgacaaacgccaaagaacctcccttgtttcagacaaagtcggaacaagtttgaagtaagaaggaagaacaaccggtacctttaagtaactttctagtggcaaggtacgcccgttcggactaaggaaacgtctagggaaccttacttaactaatttaagtggtaaacg

SEQ ID NO: 17418 - DNA, 132 bp, Homo sapiens
  misc_feature: GYAE6OF01CXXI2.12.33.C11.1.454.CMB.1.raw
  modified_base (129)..(132): a, c, t, g, unknown or other
  misc_feature (129)..(132): n is a, c, g, or t
tcagatacgacgtacacgaccggtgctcgatttagagtgagctcgttgggttgggcacagcggccctgggctgcctggtcaaggactacttcctacgtcgtatctgagcgggctggcaaggcgcatagnnnn

SEQ ID NO: 17419 - DNA, 738 bp, Homo sapiens
  misc_feature: GYAE6OF01DIYML.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtcgtgggctgaacgttgggttttccttgttgcttaattttaaaaggtgtccatgtgaggtgcaacgtggtggaggtcgggggagtgtaggtacgggccgggggtcctggagactctcagtgtgcgtaggtctaggtattactaactttacgattagtggctagtcgtaccgtcggtccgacgaacgccgtaccgaggggaggtcgtaggaggtcgggtcctggtggtcgtagtaagttaggaagtggtagtaagttagtataaggtacttagtgacgtacgtcgtcgtaggtacggacggggtcctacgttaccgacctactaccgtaccgaagacctaacgaaacccggtaccaaacggttaacccttcccgttagtttaccgacgtaaacctaaaggtaccggtaattaagtttaggaaacggtaacgggaacgggtaaacgaacccgttaaccgggttaacttttaacgttaacgtttcgtacgggttacgaccggtaaacggcccggtaccccgtagggaacccgtaaggtaacccgttacgtaacggttaaccttaacctttaacgtaagtttacggtaggttaaccggg

SEQ ID NO: 17420 - DNA, 975 bp, Homo sapiens
  misc_feature: GYAE6OF01B1PIE.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccagtggagtctgggctagtaacgttgggttttccttgttgtactttaagttttaaaaggtcgtcctacgttggtggtaggttgacgaacgttgggtagggacggggtcgggggggaggttggtacgggtaccgggggcccgggggggttccctaggacgtaccttcgtacgtagttggtcggacgtaggggttacgttaggttaactttacccgttaaaaccgttttttaacggaattttaaggtcgggaccttaacggttccggtaaccccggtttccgggggtacccccgaacccggtaaacggtaccccggttaccggggtaaaacggggggggtaacgggggtacccgttaggggggtaacgggtttccgggggtttccgtttacggttacggggttttccgttaaagggttaaaaggtttaggggtaaacggtttggggttaaggttaagttaaggtttaagttaacgttagtttaagttccggacgttacggtcgtttcgggttagggtacggggtaaccggggtccctttaacgttccccgaaccgttacgtaccccgttaccgaaacggaaccggtaaaccccaaaccggtaaccctaaaacccgggttaccccctttcccgtttaacggtttttaccgaaccggttaaccgttaaaggttaccggttaaactttaaagggttacgggaaaggtaacgggtaaaccggaaacgtaacccggttacggtttaccttttaagttacccgtttagtcgggtcgacggtaacgtcccggtaccgtagacggtaacgtacgtctacggtacttacgttagttagtgtaggttacgg

SEQ ID NO: 17421 - DNA, 638 bp, Homo sapiens
  misc_feature: GYAE6OF01AMJCM.12.33.C11.1.454.CMB.1.raw
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttattttaaaaggtgtccactgtgaggtgcaactggtgggaggtcggggggaggtggtaggtaccggggccgggggggtccctggagactctcatgtgcgagggtctggattcaactttttacgattatggcatgaccgtgggtccncaagctccgagggagggctggagtggtctcgtggtctgattggaatggtgatagtatagtattangcaggctcgtggtggacggggcctagttccacctatcctaccgaagacgaaccaaaccgacccgaaacgtaacccttcccgttagtttcgtagacctaaagtcggtaactaagtttagaaggaaggaagggaaacgaccgtaccggttacctttaattacgtttcgtggtacggtacgaggaccggtccccgtagggacgaggtacgttacgtacgtaaccttaactaactttaacttggtacggttaacggg

SEQ ID NO: 17422 - DNA, 854 bp, Homo sapiens
  misc_feature: GYAE6OF01E1CFD.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttaattttaaaaggtgtccactgtgaggtgcaacgtggtggaggtcggggggaggtggtaggtaccggggccggggggtccctggacgactctcagtgtgcgtagggtctggtattactaacttttacgtattagtggacagtcgtaccgtcggggtccccgaccaacggtcccgtaccggaagggggaacggggggtccgttagggggtacgggttcgggggttccctttcggttcgggttaccgttaggtaaagtttaggggtaaagttggggtagtaaagtttaaggttaattaaggtaagtttactaggcgtaacggtccgtttacggtagggttacggggaccggggggttaccctaagttttccccaaccgtaccgtttaccctaccggaaaggtaacggtaaaacgttaaaccccggaacccgtaaaacgtaaacccccgttcccggtttacgttttaccgtacggtaaacccgttaaaaggtaacggtaaacgtttaaacgtttaggggaaaggtaaacgggaaaacgggtaaccgtaaccgtaccgggtttaaccttttaagtttacgtttcgtacggtacggtaccggtacggtacccggtcccggttaaggacctaagggtaacctcgtaacgtaaccttaacgtaactttagttagttacggttaacggg

SEQ ID NO: 17423 - DNA, 912 bp, Homo sapiens
  misc_feature: GYAE6OF01CH521.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacgtgggtttttccttgttgacttaattttaaaaggtcgtaccactgtggaggtgcaacgtgggtgggagggtcggggggaggtaggtacggtaccgggggcccgggggggtccctggacgtaccgtctcgagttggtcgacggtagggtctggtactttacgttaactttttaacgatttagtggtctatcggtacccgtcgggtccccgaccgtaagcccggtaccggaagggggaacggggtcgttaggggacgggttgggttccgtcggtggtacgtaggtaagttgggtaagttgggtagtagttaagtaattagtattagtgacgtacggtacttcggtaggtacggggtaccggggtcccttagttacccgaacctacgttcccgtaaccgaaggtaaccgaaacccgtaaaccccggaacccgtaaaaccgttaccccgtttcccgttaccggttttacgaccggtaaaccgttaaaaggttccgggtaaactttaaacggtttaaggggaaacggttaaagggaaaccgggaaaccggtacccggttaaaccccgggtttacgttttaagtttttaacccgttttaaggttcgggttaaccggtacccgggtaaaggtaaacccccggggtccccgtaaccgggggttaaccgtaaacggggtttaccgtttaaaccgggttaaccggttaaacccggtttaacctttaaacgttaaaggtttttaacgggtggggttttaaaccggggg

SEQ ID NO: 17424 - DNA, 770 bp, Homo sapiens
  misc_feature: GYAE6OF01DIIE5.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagagactcgccatggagtctgggctgtaacgttggttttccttgttgtacttaagttttaaaaggtgtccacgtgtgaggtgcaacgtggtgggagggtcgggggaggttaggtacggtaccggggcccgggggggttccctggacgtaccgtctcagtgtggacgtaggtctggtacttacttaacttttacgattacgtgtactagtcgtaccggtcggtaccgaccgagtaccgtaccggaagggggtaacgggcgtagggtacggtcgggttccgttggttcggttacgtaaggttaagtaaggtagtggtaagtagttaagttataagtacttagtcgacgtagtcgtcggtaggacggacgggtacctacgtaccacctcgtaccctacgaacgaacgtaacccaacgtaacctaaacgtaacccccgttccgtttacgttaccgtacgtaaacgtaagttaacggtaacctttaagtaggaaaggtaagaaacggtacgtaaccgtaccgtttacgtttaagttcgttacgttcggtacgaccggtacgtacccggttacccggagggtaaacgtacggtaacgtttaccggaaccgtttaacttaccgtttaattacgggttaagttcggtaacggg

SEQ ID NO: 17425 - DNA, 899 bp, Homo sapiens
  misc_feature: GYAE6OF01ADIPB.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtcgtgggctgtaacgttgggttttccttgttgtacttaatttaaaggtgtccactgtgaggtgacaacgtggtgggaggtcggggggaggttggtacggtaccgggggtcccgggggggttccctaggacgtacctccgtacgagttcggtggtacggtaggggttcgttagggtaacttttaaccttaaacgtttttaaccggatttaaggtcggtacctagttaccggaaccggttcggggtaccccgaccgtaacggccgtaccgggaaggggtacgggtcgtagggtaggttcgggtctacggtggtactaggtaagtggtaagtggtatagtaagtacgtagtacttagacgacgtacggtcgtacgttacgggtacggggtaaccgggacccgttacttacccgtaaccttcgttaccccgtaacccgaaaggaacccgaaaaccccgaaacccggtaacccgtaaaacccggttaaccccctttccccgtttaagtttaccgtaagtaaaccgttaaacggttcggtaaacgtttaaggttacggaaaggtaacgggtaaacggtaacgtaacccggtaaccggtttactttaacgtttacggttccggttaaggaccggtaaaccggtcgggtaaccccggtaccccggttaggaaccggtaaacgggtttaacccggttccgttaaacgggttaaacccctttaagtttaaacggttagtttaacggggttacgggttaacccgggg

SEQ ID NO: 17426 - DNA, 744 bp, Homo sapiens
  misc_feature: GYAE6OF01A9235.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttattttaaaaggtgtccactgtgaggtgcaactgggtggaggtcggggggaggtgtaggtaccggggccgggggggtccctggagacctctcatgtgcgagggtctggtattctaactttttacgattagtggactatcgacctcggggtcccgccaagcctccgaggggaaggggctgggagtgggtctcgtggtctagagttggaatggtgatagtatagtattatggcaggtctcgtggtggacggggcctattccactatcctacgagacgaaccgaaccgaccgaaacgtacccttccccgttggtttacctacggtaacctaaagttacgggaacttaaacgtttagggaaacgtaaggggaacgggtaaacgtaacccgtaaccgggttaccctttaaacgtttacgttttacccgttagggtaccggtacggtaacggtaacccggtcccccggttagggacccgtaaacgggttaaaccggttccggttaaacccgggttaaaccgttaaccgtttaaaccgttttaaacggttttaacggttaacggggtttaaaccggg

SEQ ID NO: 17427 - DNA, 788 bp, Homo sapiens
  misc_feature: GYAE6OF01BBBQO.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggtttcttgttgctattttaaaaggtgtccactgtgaggtgcaactgggtggaggtcggggggagtggtagtacggggccgggggggtccctggacgactctcattgtgcgagggtctggtattcgaacttttacggatttaatggcatcgacctggtccgacagctccgagggagggctggagtgggtctcgtggtcgtagtaacgttggaattgggtagtaataggttaaatacgggtaatttagtggacgtaggtacctttcggtaggtcggaacgggggtccctaagtttccgaacccctaagttccccttaaccgaacggtaacgaaacccgaaaaccggtaaccctaaaacggtaaacccttaccccctttaggtttttaccaccggttaaacaaaacgttaagggaacttaaaacgtttttacggaaaggtaagggtaacgggtaaaacggaaccggtaaccggggttaacccttttaacggtttaattttaacccgttcggttaacggtaaccgggtaacgtaccgggtacccccgtacccggggaacgtaaaaccgggtaagttaccggttacgggtaaccttaaaccctttaacttaaacgtttacggttaaggttaaggg

SEQ ID NO: 17428 - DNA, 870 bp, Homo sapiens
  misc_feature: GYAE6OF01BCQ5H.12.33.C11.1.454.CMB.1.raw
tcagatacgacgtacacgaccggtgctcgatttagagtgagctcgttgggtttggggagctctgggagaggagccccagccctgagattcccacgtgttccatccagtgatcagcactgaacacagaggactcgccatggagtctgggctgaacttgggttttccttgttgtcttaattttaaaaggtgtccacgtggtgaggtgacaacgtgggtgggaggtcggggggaggtggtaggtaccggggccggggggtccctggacgactctcgagtggtgcgtagggtctaggtattacgtaacgttttacgtattagtacgaactacgtcgtaacccggttcggggtaccccgacccgaaacgggtcccgttacccgggaaagggggaacgggggtccgttgggggaagggtttcggggttcttacgggttcgggtttaccgtaagggttaagttagggtaagttaggggttagtaaagttaaggttaaattaggttaagtttacggtggtacggtaacggtcgttccgggttagggtcgggggaaaccgggggtaccctttaacgttaccgtaacccgtaaccgtttccctaaccggaacggtaacgtaaaaccccgaaacccgtaaaccccgtaaaaccgttaaacccccgtttccccgtttacgttttacccggaacgtaaaccgtaaaacggttacgggtaaaccttaagtttaggaaaccggtaagggaacggaaacggtaccgtaaccgggttaacctttaagtttacgtttcgtacggtacggtacgaacggtaccggtcccgtacggacggaagtacggttacgagttacctaacttaattacgttaaggtggttaacggg

SEQ ID NO: 17429 - DNA, 797 bp, Homo sapiens
  misc_feature: GYAE6OF01AILL5.12.33.C11.1.454.CMB.1.raw
tcagatacgacgtacacgaccggtgctcgatttagagtgagctcgttgggtttggggagctctgggagaggagccccagccctgagattcccacgtgttcccatccagtgatcagcactgaacacagaggactcgccatggagtctgggctgaacttgggttttccttgttgcttaattttaaaaggtgtccactgtgaggtgcaacgtgggtggagggtcggggggaggtggtaggtaccggggccgggggggtccctggagactctcagtgtgcgaggggtctggtatttacaactttttacgattagtggcagtcggtacccgttcgggtccccgaccaagccgtaccggagggggaaggggtccgtggggtaggtcggggtcttcggtgggttctaggtaaagtttgggaaagttgggttagtaagtttaaggttaagttaaggtatttaagtcgggactacgggtccttcggttgggttacgggacgggggtaccctagttacccaccgtactccgtaccgaaggaacgaaccgaaaccgacccgtaaacgtaacccttcccgttacgtttacctacgtaactaaaggtacggtaacttaagtttaggaaggtaagggaaggaaacgtaaccggtaccggttacctttaagtttacgtttacgttggtacggtaccggtacggaccccggtcccgggtaccgggtaaccgtaacgggttaaccggttacggttaaccgggttaaccgttaacccgttaaactttaacgtttaggttacgggtttaaacgggg

SEQ ID NO: 17430 - DNA, 859 bp, Homo sapiens
  misc_feature: GYAE6OF01A69GZ.12.33.C11.1.454.CMB.1.raw
tcagatacgacgtacacgaccggtgctcgatttagagtgagctcgttgggtttgggagctctgggagaggagccccagccctgagattcccacgtgtttccatccagtgatcagcactgaacacagaggactcgccagtggagtctgggctgaacgttgggttttccttgttgtacttaagttttaaaaggtgtccactggtgaggtgcaacgtgggtgggagggtcggggggaggttggtacgggtaccgggggtcccgggggggttccctaggacgtaccttccgtcgtagttggtcggcgtaggggttccgtggtactttaccttaaacgtttttacgaatttagtggactagttcggaccggttcggggtaccccaccgtaacggtcgtaccgggaagggggtaaccggggtcgtaggggtaggttcggggttccttacggttgggtaccggtagtaaaggtttacggtaaaggttggggtagttaagtaaggttaagtaagtacgtttaacgtagggacgtaacgggtcttcgggtagggtaggggtaccggggtacccttaactttcccgaaccgttattaccccggtaacgaacggtaacgaaccccgtaaacccggaacctaaaaaccgttacccgttcccgtttacgtttaccgtaacgtaacgtaaagtacggttaacgtttaagttacgggaacgggtaaggaacggtaacgtaaccgtaacccggttactttaagttacgtttacgtggtaccgtgggaaccgttacccggacccgttacggacgtaaaggtaaccggttcgtaacgtaaccttaacgttactttaacgttaaggttcggtaacggg

SEQ ID NO: 17431 - DNA, 791 bp, Homo sapiens
  misc_feature: GYAE6OF01C6TKX.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccagtggagtcgtgggctgtaacgttgggttttccttgttgtacttaagttttaaaaaggtgtcctactggtggtaggtgacgtaacgtgggtgggtacggggtcggggggtagggtggtaacgggtacccggggggccccggggggggttccccgtggtaacggtaccgtccgtcgtagtcggtggacgtagggtcgtggtacttacgttaaacttttacgtattagtgactagtcgaccgtggccgaccgacgccgtaccggaaggggacgggtcgtgggtagggttgggtcgtcgtggttacgtagtagttaggtagtggtatagttaagtagtaagtattagtgcgtagtcgtcgtaggtcggacgggtccgtacgttccgaacctcgttacctaccgaaggtaccgaaaccgaacccgaacgtaaaccgtaccctttccccgtttgttacccgtagaacttaagtaggtactttaagttagggaagtacgggaaaggtacgtaccgtaaccgttactttaacgtttgtttaccgttaggtcggacggtaccgtcccggtacccggtaggaaccggtaacgggttaacgttacccgggttacgttaaacccgtttaaacgtttacgtttaaaggttggttaagggttacggg

SEQ ID NO: 17432 - DNA, 797 bp, Homo sapiens
  misc_feature: GYAE6OF01BQWCE.12.33.C11.1.454.CMB.1.raw
  modified_base (301)..(301): a, c, t, g, unknown or other
  misc_feature (301)..(301): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttaattttaaaaggtgtccactgtgaggtgcaacgtggtggaggtcggggggagtggtaggtacggggccggggggtccctgacgactctcagtgtgcgaggtctggattctaacttttacgattagnggctaagtcgtaaccgtcgggtacccgaccgaaacgcctaccggaaggggaacgggtcgtaggaggttcggtctcgtggtctaggtaagttaggaattgggtataagttaagttaagtaggtaactttagcgacgtaggtctacgtaggtaggaaccggggtacctactttaccgaacctacgttacctaaccgtaagaacgaaaccccgaaccgaacccgaaaacgtaaccccttacccgtttacgtttacgtaacgtaacgtaaaacgtacggtaaacttaaagtttagggaaaggtaacgggtaaacggaaacggtaaacccgtaaaccgggttaccctttaaatttacgttttacgtcggttaacggtacggtaaaccggaccggtaccccggtaccggaacggtaaaccgggttaaaccggttaccggttaaccggttaaaccctttaaaccgttaaacgtttaaagtttaaacgggttgggttaaacggg

SEQ ID NO: 17433 - DNA, 778 bp, Homo sapiens
  misc_feature: GYAE6OF01CPL78.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttattttaaaaggtgtccactgtgaggtgcaacgtggtggaggtcgggggagtgtaggtacgggccggggggtcctgagactctcatgtgcgagggtctggtattctaacttttacgattagtggacagtcgaccgtcgggtcccgaccaacgccgtaccggaggggaacgggtcgtgggaggtcgggtactcgtggtccgtagtaagttagggaagtgggtagtagttaagtaagttagtaatttacgtggacgacggtcgttcgtaggtcgggtacggggtcctacgttaccgaacctactccctaccgaaggaccgaaccgaaccgaacccgaaacggtaacccttcccgttagtttaccgtacgtaaccgtaaagttcgggtaaacttaacgggtttaaggaacggaaagggtaaacgggaacgtaaccggttaaccgggttaaccttttaagttacttttccggtaggtccggtacgggaaccggttacccggtccccggttaacgggaaccggtaacggttaaccgggtaccgtttaaccggggtaaacctttaaacccttaaggtttaacgtttaggggttaacggggtttaaccggg

SEQ ID NO: 17434 - DNA, 842 bp, Homo sapiens
  misc_feature: GYAE6OF01CWEJD.12.33.C11.1.454.CMB.1.raw
  modified_base (291)..(291): a, c, t, g, unknown or other
  misc_feature (291)..(291): n is a, c, g, or t
tcagatacgacgtacacgaccggtgctcgatttagagtgagctcgtgggagaggacgccccagccctgagtattccccacgttgtttccatccagtgatcagcactagaacacagagctcgcagtggagtcgtgggctgtacgttgggttttccttgttcgtacttaagttttaaaggtcgtacctacgttggtaggaggtgacgtaacggtgggtggggaggggtcggggggtaggtagggtacggggtaccgggggccggggggtcctaggacgtactctacagtcggngcggtaggtcgtggtaactttcttaaacgttttacgtatagtggctaagtcggtaccggtcggtacccgaccgtaagtccgtacgggaaggggtcgggcgtgggtgttcggtcgtgtaggtcgtaggtaagtggtaagtaggtatagttaagtataagtagttagtgtacgtacgtgtcggtagggtcgggaccgggtaccttaccgtacctaaccgtaccttaccgacgaacggaaaccgacccgtaaacccaacccgggtaacttaccccgttacccgtttagtacggtaaaccgtaacggtaaggttaaacccggtaaagttaagggtagggtaaacggaacccggtaaaggggtaaacctaaccccgggtttaacccgtttaaggttttaacctttaaggtttaccggacggttaacgggtaacggaccggtaccgtaccgaacggacgttaaggtacgttacgtaaccgttaccttaaacgttacggtaagtttccgggtaaggtccggttaagggcccgggttagggaaccgggttaaacccggg

SEQ ID NO: 17435 - DNA, 754 bp, Homo sapiens
  misc_feature: GYAE6OF01APUL2.12.33.C11.1.454.CMB.1.raw
  modified_base (531)..(531): a, c, t, g, unknown or other
  misc_feature (531)..(531): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttattttaaaaggtgtccactgtgaggtgcaacgtggtggaggtcgggggagtgtaggtacgggccgggggtccctgagactctcatgtgcgtagggtctggtacttctaacttttacgattatggctagtcgaccgtgggtcccaccgtaaggccgtaccggaagggggaacggggtccgtaggggaggttcgggtctcgtgggttctaggtaagtttggaagttgggtagtaagttagtaattaggtatttagtcggctaaggtcttcgtgtgggaacgggtcctaagttcaccgtactcctaccgagtaacgaacccgaaaccgtaccgaaagtaacccgttccctaggtttaccngtaaactaacggttacggtaataaacggtttacgaaggtaaacggtagggtaaaccgacgttaaaccggttacctttaaggttaaccgttttcgtacggttacggtaaccggtaaccggacccggtaccccgttggggtaacccgtaacgggttaaacgttaccggtaccgggtaaacctttaaaccttacgggttaacttttaacgggtaggttaaaccggg

SEQ ID NO: 17436 - DNA, 802 bp, Homo sapiens
  misc_feature: GYAE6OF01BOZP3.12.33.C11.1.454.CMB.1.raw
tcagatacgacgtacacgaccggtgctcgatttagagtgagctcgttgggtttgggagagagaaatacattccctccaggcaaatctatgctgcgctggtctgacctgggaccctgggacattcgcccctgtgctgagttactaagatgagccagccctgcagctgtgctcacgcctcgccccagtcgccctgctgtattgtatttgctattcgttaccagacgaccacctaccgtccctcccgtacggtcccttaaggtaaacgttttaccgtttttttagtcgggggtccgtttcgggtcccgtacccgtaaccccggttggtacggaccgaaggggttaccgttaccgtacgtaccgtacggtacgttaccggaaccggaacaacgacgtaccgagtacggaactacggtaccgggtaccgggtcccccgtacgtaccgtacggtcccgttcccggggtcggggtccccttccggttcgtaacccgtttccgtttccggtaccggtccgtacccgggtaaggtcccgtaaccgtagtacgtcggtaccaaccgtacgtaccgaaagttactaacccgggacccttactttccccgtttcccctttacccgtccttcggttcctcgtccttacgttccgttcggaacggacgtacgccggtacctacctacctacgttaccgtacggtttcgggaccgtaaaccgtaacgtaacgtaaccgttaaactttaaacgtttaaacttaattttaaagttacggttacgtactaaacgacggtaaaccgaaacgtaaaaccggg

SEQ ID NO: 17437 - DNA, 726 bp, Homo sapiens
  misc_feature: GYAE6OF01B9PJK.12.33.C11.1.454.CMB.1.raw
  modified_base (423)..(423): a, c, t, g, unknown or other
  misc_feature (423)..(423): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtcgtgggctgtaacttgggttttccttgttgtcttaattttaaaaggtgtccactgtgaggtgcaacgtgggtgggaggtcgggggggaggtggtacggtacggggcccgggggggttccctggacgactctcatgtgcgaggtctggtattctaacttttacgtattagtggtcagtcgtaccgtcgggtccaccgaagccgtaccggaggggtacgggcgtggaggtcgggtctgtggtactgtagttggaagtggtagagttaagtatagtagttangacgaggtctcgtggtagggacgggtccgtagttacccaccgtatacccgacgaaacggacgtaacccgaaacccgaccgaaaacgttaacccctttcccgtttagtttacccgtagtaaaccgtaacgttaccgggtaaactttaagttacggaaaggtaacgggaacggtaaaccggacccggttaaccggttaccttttaacgttattttcggaggttcggaacgtccggacccggtcccgtaggcgtaaacgtacgtacgtacggtaccttaacgttattaacgttgttggttaaccgg

SEQ ID NO: 17438 - DNA, 593 bp, Homo sapiens
  misc_feature: GYAE6OF01C5TBR.12.33.C11.1.454.CMB.1.raw
  modified_base (182)..(182): a, c, t, g, unknown or other
  misc_feature (182)..(182): n is a, c, g, or t
  modified_base (441)..(441): a, c, t, g, unknown or other
  misc_feature (441)..(441): n is a, c, g, or t
  modified_base (533)..(533): a, c, t, g, unknown or other
  misc_feature (533)..(533): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
tcagatacgacgtacacgaccggtgctcgatttagagtgagctcgttgggtctggattcaacttttacgattatggcatgacctgggtccgccaagctccagggaagggctggagtgggtctctggtctgaattggaatgtgatagtatagattatgcaggctctgtgaggggccattcacntctccagagacaacgccaagactcctgttctgacaaagtggactaatttgagagaggaagacacggtccttattattttcgagtcgagtacggacgcccgtagaccagtaaggtctacggaacttacgtaactttattagtagtaagtcggtacgtcgtacgggaccaagggccaacgtcacgtctctcctcacgcctccgaacgaacggccctagtcccggttcctccccgaggcccacccgtcctacgaacgcgtcnccgtcggtacgggcaaacggtccgtaccggccgttcgggctaccgcgttacgataaccggtcttaccgttacttcgtaccgtcgttcgacgngggcgtacgtcgacgcgtcggaatggtacgctaggctaggcangtacccngacntgngta

SEQ ID NO: 17439 - DNA, 758 bp, Homo sapiens
  misc_feature: GYAE6OF01BE1EA.12.33.C11.1.454.CMB.1.raw
  modified_base (230)..(230): a, c, t, g, unknown or other
  misc_feature (230)..(230): n is a, c, g, or t
  modified_base (726)..(726): a, c, t, g, unknown or other
  misc_feature (726)..(726): n is a, c, g, or t
  modified_base (731)..(731): a, c, t, g, unknown or other
  misc_feature (731)..(731): n is a, c, g, or t
  modified_base (734)..(734): a, c, t, g, unknown or other
  misc_feature (734)..(734): n is a, c, g, or t
  modified_base (743)..(743): a, c, t, g, unknown or other
  misc_feature (743)..(743): n is a, c, g, or t
  modified_base (748)..(748): a, c, t, g, unknown or other
  misc_feature (748)..(748): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
tcagatacgacgtacacgaccggtgctcgatttagagtgagctcgttgggtttgggttcaacttttacgattatggcatgacctgggtccgccaagctccgagggaagggctggagtggtctctggtctgagttggaatggtgatagtatagtattatgcaggctctggtggaggggcctattccaccatcctaccagacgacaaccggaccaagtacctcccttgttcngacaaagtgaactaagtttgaggaagaaggaacgactacggtacctttagttacttttcgtgtcggtacggaacgaccgtcccgtcgggacgaaagtaacgtcgtacggtaacttacctattagttagtcggttagtcggtaccgtggtacgggaccgtaacggaccgtacgtacacgttccgtccgtcctcgaccgtccctaccgaaacggtaccgggtccctacggttcccgtttacccttccccgggtacgacccctaccccgtacccgaaccggacgtaaccgtcccgtaacccggtcggtaccgggggaccacccggtacccgggtcccggtacccggtccggggtaccgtccgggtccggttacggtaaccgggttaaccgtaacccgttttaccccgttacccggtttacggttaccgttaccgttaacggtccgggtaaccggggtccggtaacggtcggtaccggaccgttccgggacttaccgganacgcncgngcgcgacgncgacngcncngngcg

SEQ ID NO: 17440 - DNA, 820 bp, Homo sapiens
  misc_feature: GYAE6OF01C54W6.12.33.C11.1.454.CMB.1.raw
  modified_base (313)..(313): a, c, t, g, unknown or other
  misc_feature (313)..(313): n is a, c, g, or t
  modified_base (465)..(465): a, c, t, g, unknown or other
  misc_feature (465)..(465): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctagaacttgggttttccttgttgcttaattttaaaaggtgtcctactgtgaggtgctaacgtgggtggaggtcgggggaggtgtaggtaccggggccggggggtcctgagtactctcagtgtgcgtagggtctggtacttacctaacgttttaacgatttagnggctacgtaggtacccggttgggtccccgaccgtaagtcccgttacccggaaggggggaacggggtcgtcggggtaacgggttcggggttaccttccggttgggttaccgtagtaggttaggaacgttgggtatagttagtatagtattagngcgagtctcggtggacgggtacgggccgtacttaccgaacctcgtttcccaaccggtaagaaccgaaacccgtaacccgtaacccgtaaaacgttccccttcccgtttacgttttacgacgtaacgtaaagtcggtaactaagtttacggaaggtaacgggaaggtaacccggtaacggtacccggtttaacctttaacgttttaggttaccggttcggtacgggtaaccccggtacggtacccccggttacccggtacccgggtaaacggtaacccggttaaacggtccccgggtttaacggtacctttaaaaccgtttatttaacgtttaggggttaagggtttaacccgggg

SEQ ID NO: 17441 - DNA, 912 bp, Homo sapiens
  misc_feature: GYAE6OF01E0D4H.12.33.C11.1.454.CMB.1.raw
  modified_base (895)..(895): a, c, t, g, unknown or other
  misc_feature (895)..(895): n is a, c, g, or t
  modified_base (907)..(907): a, c, t, g, unknown or other
  misc_feature (907)..(907): n is a, c, g, or t
  modified_base (909)..(910): a, c, t, g, unknown or other
  misc_feature (909)..(910): n is a, c, g, or t
  modified_base (912)..(912): a, c, t, g, unknown or other
  misc_feature (912)..(912): n is a, c, g, or t
tcagatacgacgtacacgaccggtgctcgatttagagtgagctcgttgggtctggattcaacttttacgattatggcatgacctgggtccgccaagctccagggaaggggctggagtgggtctctggtctgaattggaatggtgatagtatagattatgcaggctcgtgtggagggggtcccgatttccacctaatcctaccaaggacgaacaaacgaccaaagtaacctcccttgtttcctagactaaaagttggaacttaaagtttggaaggaaggaacggaaacggaccgtaacgggtacccttttaattaacgttttccttgtacggaccggaaacggacggtaccccgtcggactaacggtaaaacggtcgttaacgggtaacctttaaaccgttaactttaacgtttaaggtttaggggtttaaacgttcggggtaaaccggttcccgggtttaacgggggaaccccgaaaaaccggggggtaaccccgtaaacccggggttactaaaccggtttcccggttaccttaccccgttaccggtaacccgtaccccgttaacccgaaaaccccggtaaaccggggtcccctaaccggtttaccccgggtttccctttaacccccccggtacggtaccccgtaacccccttacccgtaacccgtaaacggacgaaccctaacccgtcgggttaccgggggaccgaacggacgggtacccggaccccggttcggggacccgttcggtacccgttcgggtaaaccgtaacgggttaacccttaacccgtttacccgtaaccgggtttaccgttaacgttcgtaacgggaccgggtacgggtaccggtaacgggtccgaaaacgggccgtaaccgaaggttaacgagtacagtacnacgacgacagancnngn

SEQ ID NO: 17442 - DNA, 880 bp, Homo sapiens
  misc_feature: GYAE6OF01A2PO3.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttcctgttgcttattttaaaaggtgtccactgtgaggtgcaactggtggaggtcgggggagtggtaggtaccgggccggggggtccctgacgactctcagtgtgcgtagggtctaggtacttacgtaaccttttacgatttagtcggtactatcggtaccgttcggggtccccaccgaacggtcccgtaccgggaagggggtaacggggtccgttaggggacgggtttcggggttccttacgggttgggttaccgttaaggttaaaggtttcggggtaaagtttaggggtataaaggtttaaggttaactagggttaatttaagcggtacgtaagggtccttacgggtcgggtagggaccggggtaccgtaacgttacccgtaaccgtaacgttacccgtaccgaaaggtaaccgaaaccccgtaaaccggtaaccccgaaacggttacccccgttaccccgtttacggtttaacccgtacggtaaactaaacgggtttaccggtaaacgttaaaggttttacgggaaaagggtaaacgggtaaaccgggtaaaaccggtaaccgggttaacccggtttaaccgtttttaagttaaccgttttcgtaacggttccgggaccgggttaccggtacccggtcccggtaggtaccggtaaacgggttacgtacgtaccggttaaactaccgttttaaagtacgtttggttacggttaacgg

SEQ ID NO: 17443 - DNA, 721 bp, Homo sapiens
  misc_feature: GYAE6OF01DPH0V.12.33.C11.1.454.CMB.1.raw
  modified_base (437)..(437): a, c, t, g, unknown or other
  misc_feature (437)..(437): n is a, c, g, or t
tcagatacgacgtacacgaccggtgctcgatttagagtgagctcgttgggtttggggagctctgggagaggagcccccagccctgagacttcccacgtgtttccatccagtgatcagcactgaacacagaggactcgccagtggagtctgggctagtaacgttgggttttccttgttgtcttaattttaaaaggtgtccatgtggaggtgctaacgtggtgggagggtcgggggaggtggtaggtaccggggtcccggggggtcctggagtactctcagtgtgacggtggtcgtaggtacttacgttaacgttttacgtattagtgtctagtcgtaccgtcgggtcccaccgagccgtaccggaggggagggcgtggaggtcggttctcggtcgttcgtagtagtaggtagtgtagtattagtaagtaagtattagngtcggtacgtcttcggtgggtacgggtacgggtcctacttccgacctactacccgaccgtaaggaccgaaaccgaacccgtaaccgtaaaccgtaacccttcccgtttgttaccgacgtaactaaaggttacgtaagtttaagttgggaagaacggtaaggtaacgaccgttacgttacttaagtttcttaggtcgtacggcgacgtccccggtccgtacggaggtaacgtacgttcggtaacgttaaccttaacgttaatttacgttacggtgttacccgggg

SEQ ID NO: 17444 - DNA, 523 bp, Homo sapiens
  misc_feature: GYAE6OF02F1YFG.12.33.C11.1.454.CMB.1.raw
  modified_base (502)..(502): a, c, t, g, unknown or other
  misc_feature (502)..(502): n is a, c, g, or t
  modified_base (518)..(518): a, c, t, g, unknown or other
  misc_feature (518)..(518): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgattggaatggtgatagtatagattatgcaggctctgtgaggggccgattcaccatctccagagacaacgccaagactccctgttctgacaaatgacaatttgagagaggaagacacggtcttatatttctgtgcgagacgccctcggcagagtcnggactactactattanggtag

SEQ ID NO: 17445 - DNA, 486 bp, Homo sapiens
  misc_feature: GYAE6OF02GVDEX.12.33.C11.1.454.CMB.1.raw
  modified_base (480)..(486): a, c, t, g, unknown or other
  misc_feature (480)..(486): n is a, c, g, or t
tcagatacgacgtacacgaccggtgctcgatttagagtgagctcgttgggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggattactactattatggtatggacgtctggggccaagggaccacggtcatcgtctcctcagcctccaccaaggcccatcggtcttccccctggccaccctcctccaagagcacctctgggggcacagcggccctgggctgcctggtcagactacttcctacgtcgtatctgagcggctggcagcgcatgnnnnnnn

SEQ ID NO: 17446 - DNA, 535 bp, Homo sapiens
  misc_feature: GYAE6OF02HRYZJ.12.33.C11.1.454.CMB.1.raw
  modified_base (306)..(306): a, c, t, g, unknown or other
  misc_feature (306)..(306): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcgggggaggtgtagtacgggcgggggggtccctgagactctcatgtgcagggtctggattcaacttttacgattatggcatgacctgggtccnccaagctccgaggggaaggggctgggagtgggtctcgtggtctgaattggaatggtgatagtatagattatgcaggctctggtggaggggccattcaccatctaccagagacaacgaccaagaacctccctgtttctgacaaatgactaatttgagagaggaagacacgtacttatatttcgtgtgcgagacgccctcggcagagtctggactactactattagtgtag

SEQ ID NO: 17447 - DNA, 548 bp, Homo sapiens
  misc_feature: GYAE6OF02FZG1W.12.33.C11.1.454.CMB.1.raw
  modified_base (305)..(305): a, c, t, g, unknown or other
  misc_feature (305)..(305): n is a, c, g, or t
  modified_base (438)..(438): a, c, t, g, unknown or other
  misc_feature (438)..(438): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctatttaaaaggtgtccactgtgaggtgcaactggtggagtcgggggaggtgtagtacgggccggggggtccctgagactctcatgtgcagggtctggattcaacttttacgattatggcatgacctgggtccnccaagctccgaggggaaggggctgggagtgggtctcgtggtctgaattggaatggtgatagtatagattatgcaggctctgtggaggggccattcaccatctccagagacaacgccaaagacctccctgttcngcaaatggactaagtttgaagagaggaagaacacggtccttaatactttctgtgcgaggacgcccctaggcaaggtagtcctaggaccttacctactattagtggtaacg

SEQ ID NO: 17448 - DNA, 494 bp, Homo sapiens
  misc_feature: GYAE6OF02GO75A.12.33.C11.1.454.CMB.1.raw
  modified_base (479)..(479): a, c, t, g, unknown or other
  misc_feature (479)..(479): n is a, c, g, or t
  modified_base (484)..(494): a, c, t, g, unknown or other
  misc_feature (484)..(494): n is a, c, g, or t
tcagatacgacgtacacgaccggtgctcgatttagagtgagctcgttgggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagacgcacctctggggcacagcggccctgggctgcctggtcaaggctacttcctacgtcgtatctgagcgggctggcaaggcgnatagnnnnnnnnnnn

SEQ ID NO: 17449 - DNA, 544 bp, Homo sapiens
  misc_feature: GYAE6OF02F43PR.12.33.C11.1.454.CMB.1.raw
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (436)..(436): a, c, t, g, unknown or other
  misc_feature (436)..(436): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacgggccgggggggtccctggagactctcatgtgcaggggtctggattcaacttttacgattatggcatgacctgggtccnccaagctccagggaggggctggagtgggtctctggtctgaattggaatggtgatagtatagattatgcaggctntgtgaggggccattcaccatctccagagacaacgccaagaacctcctgttcngacaatgactaatttgagagaggaagacacggtaccttatactttctgttgcgagacgcccgtcggacaagaagtcgtaggaccttactactatttacgtggttaacg

SEQ ID NO: 17450 - DNA, 527 bp, Homo sapiens
  misc_feature: GYAE6OF02IRWP3.12.33.C11.1.454.CMB.1.raw
  modified_base (319)..(319): a, c, t, g, unknown or other
  misc_feature (319)..(319): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagatacgacgtacacgaccggtgctcgatttagagtgagctcgttgggtttggggagagagaaatacattccctccaggcaaatctatgctgcgctggtctgacctgggaccctggggacattgcccctgtgctgagttactaagatgagccagccctgcagctgtgctcagcctgccccatgccctgctgattgatttgcatgttccagagcacagcctcctgccctgtaagtacttttttatgggctggtcgcacccctgtgcaggagtcagtctcagtcaggacacagcagtggacagtcggacgggtccccgntcgacgcctccgtggggtcctccgtgctacgtcgtcggctccggacggtcgccagactgtcgacactccgagatcgaccctagttccctcccttccctcccttgtcctcgctactcgtgtcgganacncgcgtcacactcaccgttgcgactacgtcgaagtactattaacctaatttactttaattgtatacagtacagtaaaccgg

SEQ ID NO: 17451 - DNA, 541 bp, Homo sapiens
  misc_feature: GYAE6OF02H61DC.12.33.C11.1.454.CMB.1.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (481)..(481): a, c, t, g, unknown or other
  misc_feature (481)..(481): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcgggggagtgtagtacggccggggggtccctgagactctcatgtgcagggtctggatttcaactttttacgattatggcatgacctgggtccncaagctccgaggggaaggggctgggagtgggtctcgtggtctgaattggaatggngatagtatagattatgcaggctctgtggacggggcctattcaccntcctcagagacaacgccaagacctcctgttctgacaatgacattgagtagagagacgacgtcttatattctgtcncgagtacgcccgtcggacaaggtaacgtcgtacggactacttacgtatttagtggttacg

SEQ ID NO: 17452 - DNA, 540 bp, Homo sapiens
  misc_feature: GYAE6OF02I574H.12.33.C11.1.454.CMB.1.raw
  modified_base (527)..(530): a, c, t, g, unknown or other
  misc_feature (527)..(530): n is a, c, g, or t
  modified_base (532)..(540): a, c, t, g, unknown or other
  misc_feature (532)..(540): n is a, c, g, or t
tcagatacgacgtacacgaccggtgctcgatttagagtgagctcgttgggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcacgcctccaccgaacgggcccacgtccggtccttccccctcggccacccctcctccaacgagccacctcgtcggggcacgacgccggcccgtgggcctcgccgtcggtaccgaacggtacctaccttccgtaccgttcgtactcgtgacgcgggctcggcgaaggccacgagtacgnnnncnnnnnnnnn

SEQ ID NO: 17453 - DNA, 638 bp, Homo sapiens
  misc_feature: GYAE6OF02I22MA.12.33.C11.1.454.CMB.1.raw
  modified_base (446)..(446): a, c, t, g, unknown or other
  misc_feature (446)..(446): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttattttaaaaggtgtccactgtgaggtgcaactggtggaggtcggggggaggtgtaggtacgggccgggggggtccctggagactctcatgtgcgagggtctggattactaacttttacgatttagtggcatcgaccgtggggtcccgccgaagccgtaccgagggggaacgggcgtgggaggtgggtctcgtggtctgtaattggaatggtagattagtagtagtattagtgacgaggtctgtggtgggacggggcctagttcacctatccncaagacgaccaacgaccaaagtacccttccttagttcagaactaaagtcgaacttaagttacgaagtaaggaaggaacgtaccgtacggttacctttaagttacttcgtagtcgacgtagtccggtacccgtcgggataacggtacgtcgtacggtaacccttaacgttacttaagttaggttagttaacgg

SEQ ID NO: 17454 - DNA, 761 bp, Homo sapiens
  misc_feature: GYAE6OF02HZ1AL.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactgggtggaggtcggggggaggtgtaggtacgggccgggggggtccctgagactctcatgtgcgagggtctggattcaacttttacgattatggcatcgaccgtgggtcccgaccaagcctaccggaaggggacggggctgggagtgggtcctcgtggtctgtaagttggaatggtgtaagttagtattaagtattatgacaggtccttacgtggtgggacggggtccgtacgttccaacccgtactccgtacccgaaggaccgtaaaccgaaacgtacccgaaagtaaaccccgttcccgtttagtttaccgagtaaccgttaaaaggttcggaaaccttttaagtttaagggaaaggtaaaggggaaacgggtaaaaccgtaacccggggttaaccggttaaccccttttttaaagtttaacgttttccggttacggttccgggtaaccgtacgggtacccgtacccccgggttcggaaccggtaaggttaaaccgtttccggtaacgggtaaccctttaaccgttaaacgtttaatttacggtagggtttaacgg

SEQ ID NO: 17455 - DNA, 1068 bp, Homo sapiens
  misc_feature: GYAE6OF02F85YR.12.33.C11.1.454.CMB.1.raw
tcagatacgacgtacacgaccggtgctcgatttagagtgagctcgttgggtttggggagctctggggagggaggacccgaccccgaccgtcccgtaggaagttacccttaccccgtacggttttccgtttacctacctacccgtaggtagtactacgacgacctacgtaacgaaaccaacgaagggaacggtaccgtcccgacctaggtagggtacgttcgggtcgggtcgtaacggttaacgggtttttccgggttttttccgttttggttacgttacgtttttaaaaaggtttttaaaggtccgtaccctagttggtaggtaggtacgaccgtaggtggggtagggtacggggggtacggggggtaggttaggttaaccggggtaccccgggggggggtccccgggggttccgtaggaaccgtccgttccgtacgtaggttggtcggacgggtacgggttcgtaggttactttaaccgttttaaaccgttttagttaacgtttaggtcggtaacttaggtacccgttaaccggggttcccgggtaccccgtaaacggtaaccggtcccgtaaccggggggaaagggggggtaaccgggtcgggttaggggtcggggttcggtttccgttgggttcggttacgttaaagttaagggttaggtaggttgggtaagttaaggttaagttaagttaagtttaacgtttagtcggtaacggtcgttccgttcgggtaggggtacgggggtacccgggtaccttacttaccccgaaccttaccgtcccgtaacgacggaaccgaaacccgtacccgaaaccgtaaaccgttacccctttccggtttacgttaccgtacggtaaacttaacggtacggtaaactttaggtaaggaagggaaacggtaaggaaaccgtaccggtaccgtttaacgtttaactttcgtttcggacgtacgggtacgtaccggtccccgtccgggtaccgtaacggtaacggttacccggttacggttaacccgttaaccgttttaaaccgttaagtttaacggtttaggtttacgggtaaccggg

SEQ ID NO: 17456 - DNA, 515 bp, Homo sapiens
  misc_feature: GYAE6OF02IAH1V.12.33.C11.1.454.CMB.1.raw
  modified_base (383)..(383): a, c, t, g, unknown or other
  misc_feature (383)..(383): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
  modified_base (501)..(506): a, c, t, g, unknown or other
  misc_feature (501)..(506): n is a, c, g, or t
  modified_base (508)..(515): a, c, t, g, unknown or other
  misc_feature (508)..(515): n is a, c, g, or t
tcagatacgacgtacacgaccggtgctcgatttagagtgagctcgttgggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaatggacattgagagaggaagacacggccttatatttctgtgcgagacgccctcggcaggaagtctggactactactattagtgtatggacgtcgtcggggccaagggaccacggtcatcgtctcctcagcctaccaccacggcccatcggtccttccccgngccaccctcctaccagacgcacctcgtcggggcacgacgccggcccgtgggcctgccgtggtacaacggactacgttcctacgtcgtatcgtaggngcgggctggcaaggcncagtgnnnnnngnnnnnnnn

SEQ ID NO: 17457 - DNA, 735 bp, Homo sapiens
  misc_feature: GYAE6OF02GSNXO.12.33.C11.1.454.CMB.1.raw
  modified_base (302)..(302): a, c, t, g, unknown or other
  misc_feature (302)..(302): n is a, c, g, or t
  modified_base (478)..(478): a, c, t, g, unknown or other
  misc_feature (478)..(478): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttaattttaaaaggtgtccactgtgaggtgcaacgtggtggaggtcggggggaggtgtaggtacgggccgggggggtcctggagacctctcatgtgcagggtctggattactaacttttacgatttagnggctagtcgaccgttcggggtcccaccgaaagcccgtaccggaagggggacgggcggtggaggttcgggtctcgttggtcgtaggtaagttaggaagttgggtagtaataggttaataggtaatttagtgacgtaggtccttcgtgggtagggacggggtaccctattcccaactntccaccaagacgaaccaaccgaccaaacgtaaccctcccgtttagtttccgacgtaactaaagtcggtaaattaagtttaggaagaacggtaagggaaaccgtaccgtaaccggttaccgtttaacttttacgtttacgacgggttacggacggtaacggccggtaaccccggtagggaaccgttaagggtaaccgtttccggtaacgggttaaaccttaaccgtttaacgtttaacgtttaggtagggttaaacgg

SEQ ID NO: 17458 - DNA, 722 bp, Homo sapiens
  misc_feature: GYAE6OF02GTWZE.12.33.C11.1.454.CMB.1.raw
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagatacgacgtacacgaccggtgctcgatttagagtgagctcgttgggtttggggagctctgggagaggagccccagccctgagattccccacgtgtttccatccagtgatcagcactgaacacagaggactcgccatggagtctgggctgaactgggttttccttgttgctattttaaaaggtgtccactgtgaggtgcaactggtggaggtcgggggagtgtagtacgggccggggggtccctgagactctcatgtgcgagggtctggattcaacttttacgattagtggctatcgaccgtgggtcccnccaagcctaccgaagggaggggctggagtgggtctgtggtctgaattggaatgggtanatagtatagattangacaggctcgtggtggacggggtccattccacctactcctacgaagacgaaccaaaccggacccaaacgtaaccctcccgtttagtttcctacgaactaaacgttcgggaaacttaagttttaggaaacgaagggtaagggaaacgacccggtaacccgggttacccttttaaagttaccggtttttacgttacgggtttacgtaccgggtaacggtaacccggtccccgggtaccggggtaacccgtaaacggggtaaaccggtttccggttaaccggggtaaccctttaaaccgttaacccgttttaagttttaacgggtttagggtttaacggg

SEQ ID NO: 17459 - DNA, 745 bp, Homo sapiens
  misc_feature: GYAE6OF02IW5TY.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaacttgggttttccttgttgcttatttaaaggtgtccactgtgaggtgcaactggtggaggtcggggggaggtggtaggtacgggccgggggggtccctggagactcgtcagtgtgcgagggtctggattctaactttacgattagtggactatcgaccgtgggtcccgaccgtaacgcctaccggaaggggaaggggctagggaggttcgggtcctcgtcgggtcgtaggtaagttcggggaattgggtagaagttagtaataggtaatttagtgacgtagggtccttgtaggtcgggacggggtccgtaattcccgacctaagttcccgtaaccgaaggaaccggtaacccgaaaccgtacccgaaaaccggtaacccctttccccgtttaggtttaccgacgtaaacgtaaagtcgggtaaaccttagttaacggaaggtaacggaaggtaaaaccgccggtaaaccgggttacctttaagttaacgtttccgaggttaccgaccggtaaggacccgtcccggtaggacctaacgggtaacgttcggtaacgtaactttaaccgtaatttcgttaaggtcggttaaacgg

SEQ ID NO: 17460 - DNA, 637 bp, Homo sapiens
  misc_feature: GYAE6OF02F5F5Z.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttattttaaaaggtgtccactgtgaggtgcaactggtggagtcgggggagtgtagtacgggccggggggtccctgagactctcatgtgcgagggtctggtacttcaacttttacgattatggcatgacctgggtcccacgaagcctccgaaggggacgggctggaggtggtctgtggtctgtattggatggtgagtagtataggtattagtgacgtaggtcttgtggtagggacggggtccaactttccgacctatcctacgtagacgacgaaaccgaccgtaaacgtaacccttcccgttagtttccagtactaaacgtcgtaacttaattacgaaggtaaggacggaaacgtaccgtaccgttacgttaacttcgtttacgtgtacgtacggtagtaccgtcccgtacggacgaacgtacgttacgtaggtaaccttacgtaacttagtttagtaggttacgg

SEQ ID NO: 17461 - DNA, 571 bp, Homo sapiens
  misc_feature: GYAE6OF02G06ZP.12.33.C11.1.454.CMB.1.raw
  modified_base (502)..(502): a, c, t, g, unknown or other
  misc_feature (502)..(502): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctggagactctcatgtgcagggtctggattcaacttttacgattatggcatgacctgggtccgccaagctccgagggaacgggctggagtgggtctcgtggtctgaattggaatggtgatagtatagattatgcaggctcgtgtggaggggccgtattcacctatctaccagacgacaacgaccaaagaaccctcccgtgtttccacgacaagtcgaacttagtgagaggaagacgacgacgtctttattacttcgngtacgacgagtccgcccgtacgacgtaagtacgtcgacgttactaacttacgttattagtaggttacgg

SEQ ID NO: 17462 - DNA, 598 bp, Homo sapiens
  misc_feature: GYAE6OF02JXU0G.12.33.C11.1.454.CMB.1.raw
  modified_base (220)..(220): a, c, t, g, unknown or other
  misc_feature (220)..(220): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
  modified_base (536)..(536): a, c, t, g, unknown or other
  misc_feature (536)..(536): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagatacgacgtacacgaccggtgctcgatttagagtgagctcgttgggtcgtggattcaacttttacgattatggcatgacctgggtccgccaagctccaggggaaggggctggagtgggtctctggtctgaattggaatggtgatagtatagattatggtcaggctctgtggaggggccattcaccatctcagagacaacgcaagaactcctgttcngacaatggactattgagagaggaagcacgcttattagttctgtgacgatacgacccgttggactaagtagtctggaacttacgttacgtattacgtaggtacgtaggtaccggtcgtcggggccgtaaaggggaccctacggtacagtaccgtcctaccgtacgacgtacccgtaccaaccggaacggccctaacggttcgtcccttccccgnggccctaccctcctaccgactacgccnccgtcggcggacacgacggccgacccgcggtcgtcgccgtcggtaccaacgtccgtacctcgtacgtctacgttcngggacgcgggtcgcggacgaggacncgtaangggtnacgtgacgtcngcncntcngtntntc

SEQ ID NO: 17463 - DNA, 595 bp, Homo sapiens
  misc_feature: GYAE6OF02F53TH.12.33.C11.1.454.CMB.1.raw
  modified_base (422)..(422): a, c, t, g, unknown or other
  misc_feature (422)..(422): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggaggtcgggggaggtgtagtacgggccgggggggtccctggagactctcatgtgcgagggtctggattctaacttttacgattagtggctatgaccgtgggtcccgcaagctccgaggggagggcgtggaggtggtctcgtggtctgtaattggaatgggtgatagtatagtattatgacaggctcgtggtgggacggggcctagttcacctntcctaccgagacgacaaccgaccaaacgtaacccttcccttgtttcgcgtaacaagtggtaactagtttagaagaggagaacgacgacggttacttattacttcgtgtcgagtagaccgtcccgtacggacgtaggtacgtcgtacgacttactacgttagttagtgttacgg

SEQ ID NO: 17464 - DNA, 874 bp, Homo sapiens
  misc_feature: GYAE6OF02FPHRT.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccagtggagtcgtgggctagaacttgggttttccttgttgtcttaagttttaaaaggtgtccactgtgaggtgcaacgtgggtgggagggtcggggggagtggtaggtaccggggccgggggggtcctgacgactctcatgtgcgtaggtctggtacttactaacttttacgatttaagtggactagttccggtaaccggttcggggtccccgtacccgaaaggtcccgttacccgggaaaggggggtaacggggccgttagggggtaggtacggggtttcctcgggttacgggttactaggttaaaggtttaggggaacgttggggttaagtaagtttaaggtttaagtaacgggtttaatttaggcggtaaccggtaggtacctttcgtaggggttacgggaacggggggtcccctttaagttaccccgtaaccgttaccgttacccgttacccgaacggaaccgaaacccggtaaaacccggaaccccgtaaacgggttaaaccccctttcccccggttttagttttaccccgtaacggtaaaccgttaaacggtcgggtaaaactttaaaggtttacgggtaagaagggtaaacgggaaacgaaccggttaccggttactttaacgtttaagtttccgtagttcggacgacggtaccgtcccggtaccggagtacgggtaacttccggtaggttaacccttaccgttaagttactttacgggttagttaaccggg

SEQ ID NO: 17465 - DNA, 573 bp, Homo sapiens
  misc_feature: GYAE6OF02FSUJ1.12.33.C11.1.454.CMB.1.raw
  modified_base (118)..(118): a, c, t, g, unknown or other
  misc_feature (118)..(118): n is a, c, g, or t
  modified_base (362)..(362): a, c, t, g, unknown or other
  misc_feature (362)..(362): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (560)..(560): a, c, t, g, unknown or other
  misc_feature (560)..(560): n is a, c, g, or t
  modified_base (571)..(572): a, c, t, g, unknown or other
  misc_feature (571)..(572): n is a, c, g, or t
tcagatacgacgtacacgaccggtgctcgatttagagtgagctcgttgggtttggggttcgaacttttacgagttactggcatgacctgggtccgccaagctccagggaagggctggngtgggtctctgtctgattggaatggtgatagtatagattatgcaggctctgtcgaggggcccgattcaccatcctccaggagacaacgccaagaactccctgtttctgcaaatggactaatttgagagaggaagacacggtccttatatttctgtgcgagacgccctcggcaacgaagtcgtggactactactattatgtataggtactcgtggggaccacggaccgacgtcatcgtctcctcncgcctcaccgacggccacgtcggtcctccccgtgccaccctccgtccaagcgccactcggtcgggggcacggacgccggacccgttggggcctccggtaccgttgggtacctacggttacgtactttcccgtaacgtcgttactgttcggagcggtcgcgacgacggcgactagtacgcngtcgncgtcacgtcgtcncgactcactcnnc

SEQ ID NO: 17466 - DNA, 582 bp, Homo sapiens
  misc_feature: GYAE6OF02F8SGY.12.33.C11.1.454.CMB.1.raw
  modified_base (537)..(537): a, c, t, g, unknown or other
  misc_feature (537)..(537): n is a, c, g, or t
  modified_base (568)..(568): a, c, t, g, unknown or other
  misc_feature (568)..(568): n is a, c, g, or t
  modified_base (570)..(582): a, c, t, g, unknown or other
  misc_feature (570)..(582): n is a, c, g, or t
tcagatacgacgtacacgaccggtgctcgatttagagtgagctcgttgggtctggattcaacttttacgattatggcatgacctgggtccgccaagctccagggaaggggctgggagtgggtctctggtctgaattggaatggtgatagtatagattatgcgaggctctgtgaggggccattcaccatctccagacgaccaacgccaaagtaaccctcccttgtttctcgactaaatcgggaactaatttgacgaggaacggaaagacgaccggccttaattactttctgtgcgagacgcctcggcagaagtctggactaactactattatggtatggacgtcggtgggaccgaaggggaccacggtcagtccgtactcctcgacgccctacccaccgaacggtccactccggttcctccccccgttaggccccaccccttcctacccgaaagactcccgaaccgtcggtcgggcacgacgaccggccgtcgggctacgcccgttggacaacgtactcttccgacgttctctaccgngaccggcggcgtgactacgggcgacagtagngnnnnnnnnnnnnn

SEQ ID NO: 17467 - DNA, 771 bp, Homo sapiens
  misc_feature: GYAE6OF02F3QRU.12.33.C11.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagatacgacgtacacgaccggtgctcgatttagagtgagctcgttgggtttggggagctctgggagaggagccccagccctgagattccccacgtgtttccatccagtgatcagcactgaacacagaggactcgccatggagtctgggctgaactgggttttccttggttgcttaattttaaaaggtgtccactgtgaggtgcaacgtggtggaggtcggggggaggtggtaggtaccggggccgggggggttccctggagactctcatgtgcgagggtctggacttctaacttttacgattatggcatgaccgttggggtccccaccgaacgtcctccgggaggggtaacgggcgtagggaggtcgggtcttcgtaggtcgtagtagttaggagtggtgtaataagtntaagtattangacgaggtcttcgtggttaggacggggtcctacgttcctacctacgttccgtaccgtagaacgaaccgaaccgaacccgaaacggtaaccccttaacccgtttcgttttaccgtacgtaaacgtaaacgttaagggtaaccgttaaagtttaacgggaaaggaagggtaaacggaaacgggtaacccgaaccggggttttaccctttaaacgtttacgttttacgttcggttacggacggtaacggtaccggtaccccggtaccgggacgtaaacggtacggtttaccggtaacggttaacccgttaaccgtttaacccgtttaagttttacggttacggtttaaccggg

SEQ ID NO: 17468 - DNA, 621 bp, Homo sapiens
  misc_feature: GYAE6OF02FGYLF.12.33.C11.1.454.CMB.1.raw
  modified_base (340)..(340): a, c, t, g, unknown or other
  misc_feature (340)..(340): n is a, c, g, or t
  modified_base (557)..(557): a, c, t, g, unknown or other
  misc_feature (557)..(557): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttcctgttgctattttaaaggtgtccactgtgaggtgcaactggtggagtcgggggagtgtagtacgggccggggggtccctgagactctcatgtgcgagggtctggattcaaactttttacgatttagtggtctagtgaccgtgggtcccgaccaagcctaccgagggaagggctggngtgggtctcgtggtctaggacgtttggaactgggtagactaagtagtagacgtttacggtctagggccttcgtaggtgggaccgggggtcctagtacccaccgtatcctaccgagtacgaaccaaccgtaccgaactaacctcccttggtttcccagtacaagtcggactagtttaggataggagacgacgacgtcttactatttcgtagtcgtagngaccgtccgcggtacacggaagttcgacggtaccgttaacgttacctagttacgttaggtacgg

SEQ ID NO: 17469 - DNA, 1014 bp, Homo sapiens
  misc_feature: GYAE6OF02HTE9E.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggatcgtggctgtaacgttgggttttccttgttgacttaagtttttaaaaggtcgtacccactgtgaggtcgacaacgtgggtaggagggtcggggggtagttcggttacgggtaccggggtcccggggggggttccctaggacggtaccttaccgtacgattcggtcgaccgtaggggttcttggttaactttaccgttaacgtttttacgtatttaacgtggtacctacgtacggtacccggttcgggtaccccgaaccgaacggtaccgtacccgggaaggggggtacggggtacggttacggggtacggtttcggggttccttacggttacgggttacgtacgggtttaaagttacgggtaaggttgggttaagtaaacggttagttaaagttaggtaacgtttagcggtacacggttaccgtttcggtaggttacgggggtaccggggtacctttaacgttacccggaaccttacgttcccgtaaaccgaggtaaacccgacctaaaacccggtaccgttaaaaacccgttccccgtttcccgtttttaggttttacccgtaacggtaaacgtttaaaaccgggttacggaaaacctttttaaaccgggggttttaagaaacccggggtaaacggggtaaaacggttaaccccgggttaaacccggttaaaccccgggtttaccttttttaaaaagttttccgggtttaaacccgggttgggttttaaacccgggaccggggtttaaccgggaaacccccggttaccgggtttacccggggaaaacgtttaacggtaacggggtttaccgtttacggtaaacccgtttaactttaccggtttaaagtttacgggtttacgggtaaccggg

SEQ ID NO: 17470 - DNA, 725 bp, Homo sapiens
  misc_feature: GYAE6OF02IUPJE.12.33.C11.1.454.CMB.1.raw
  modified_base (677)..(677): a, c, t, g, unknown or other
  misc_feature (677)..(677): n is a, c, g, or t
  modified_base (693)..(693): a, c, t, g, unknown or other
  misc_feature (693)..(693): n is a, c, g, or t
  modified_base (698)..(698): a, c, t, g, unknown or other
  misc_feature (698)..(698): n is a, c, g, or t
  modified_base (701)..(701): a, c, t, g, unknown or other
  misc_feature (701)..(701): n is a, c, g, or t
  modified_base (707)..(707): a, c, t, g, unknown or other
  misc_feature (707)..(707): n is a, c, g, or t
  modified_base (713)..(713): a, c, t, g, unknown or other
  misc_feature (713)..(713): n is a, c, g, or t
  modified_base (717)..(717): a, c, t, g, unknown or other
  misc_feature (717)..(717): n is a, c, g, or t
tcagatacgacgtacacgaccggtgctcgatttagagtgagctcgttgggtcgtggattcaacttttacgattatggcatgacctgggtccgccaagctccgagggaagggctggagtgggtctctggtctgaatggaatggtgatagtatagattatgcgaggctcgtgtggaggggccgtattcaccatctccagacgacaacgcaacgaactcccttgtttctacggactaaagtcggtaactaatttacggaaggtagaagggaaacgacgacggtaccttattaacttttcgtaggttcggacgtaacggtacgcccgttcggaccgtaaggaaagtccgtaaggtaaccttacttaacttagttattcgggtaagtcggaacgttcggtcggggtacctaaacggggtaaccacgggttacacgttccgtacctccgttcccgaccgtccccgtaacccgaacccggtaaacgggtccccgttaacgttacccgggttcccgttacccccggttacgggccctaaccccgttcccgttaccgaaaccgggacgtaccctaccggtccggtcggggacaccgggtacgacccggtccgtacgggctacggtccgtacggtaccgaacgttcctaccgttaccgtacggtccttagtccgtaggccgtcgggntcggtacgcgccgtangacgntanctacgntgatcngcgntcggtacg

SEQ ID NO: 17471 - DNA, 850 bp, Homo sapiens
  misc_feature: GYAE6OF02I1RTI.12.33.C11.1.454.CMB.1.raw
  modified_base (209)..(209): a, c, t, g, unknown or other
  misc_feature (209)..(209): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttattttaaaaggtgtccactgtgaggtgcaactggnggaggtcgggggagtgtaggtacgggccggggggtcctggagactcgtcatggtgcgtagggtctggactttcgtaaacttttacggattaagtcgggactacgttacggacccgttggggtaccccgtaccaacggtccgtaccggaagggggtaacggggtcgtaggggaggttggggtcctacgtgggttccgtaaggttaagttggggaaattggggtataagttaacgggtaaataagggtaactttaagtcggacgtaagggtccttacggttgggtagggaccgggggtacctatttacccgaacctaagttccctaaccgaaggaaaccgtaaccgaaaaccggtaacccgtaaaaccgggttaacccctaccccgttttacggtttacccgtaccggtaaaccgttaaaacggttaccggtaaacttaaaccggttttagggaaaacgggtaacgggtaaacggaaacggtaaccggtaaacccggtttacccgttttaaagtttacgtttaccgtagggtacgtacgtaaccgggtaacccgttccccggtaaccgggtagtaaccggtaaacggttcccgtaacgggttaacccttaaacccggtttataacgtttaggtagttaacggg

SEQ ID NO: 17472 - DNA, 805 bp, Homo sapiens
  misc_feature: GYAE6OF02JANG5.12.33.C11.1.454.CMB.1.raw
  modified_base (786)..(786): a, c, t, g, unknown or other
  misc_feature (786)..(786): n is a, c, g, or t
  modified_base (796)..(797): a, c, t, g, unknown or other
  misc_feature (796)..(797): n is a, c, g, or t
tcagatacgacgtacacgaccggtgctcgatttagagtgagctcgttgggtttgggttcaacttttacgattatggcatgacctgggtccgccaagctccagggaaggggctggagtgggtctctggtctgaattggaatggtgatagtatagattatgcaggctcgggtgtggaggggcgtattcaccatctccagagacaacgcaagaactcctgtttctgacaatggactattgagagaggaagacacggtccttattacttcgtgtgcgagaccgtcccgtcggacaagtacgtcgtaggactaactacttaattagtaggttagtggtaccggttcggtacgggggtaaccgaaacggggtacccgtaaccggttaccgacgttccggttacccttcccgtaccgtacgtccccgttacccgaaaccccggaaccggggtaccccgtaacggtttcccgggtttccccgtttaccccccgttccggaccccgtacccccttaccccgtaacccgtaaacgtaccgtacccgtacccgtcggggtacggggccctaacggaccgggtcccgggtaccccggttgggtacccgttccggtacccggtttgggtaaccgtaaaccgggttaaccgttacccccgttttaacccggttaaccgggtttaaccgtttacggttaccgggttaggggtacccgggtccgggggttaccggtacggggtaaaccggtaaacgggtcccggtaacgaacggttacggcttacgacgtgacgacgtacgngacacgtacnnctagacta

SEQ ID NO: 17473 - DNA, 810 bp, Homo sapiens
  misc_feature: GYAE6OF02I8UZU.12.33.C11.1.454.CMB.1.raw
tcagatacgacgtacacgaccggtgctcgatttagagtgagctcgttgggtttggggagagagaaatacattccctccaggcaaatctatgctgcgctggtctgacctgggaccctgggacattgccctgtgctgagttactaagatgagccagccctgcagctgtcgctcagcctcgccccatcgccctgtcctgtattcgtagtttcgactagttcgttacccgaagacgaccaccgtacgtccccttccctcggcccttaaggtaaacgtttacctttttttaggcgggtcgttcggtccctaccgtcccgttgtcggaccgtaggtacgtctacggttctacgtacgtaccgaaggacctacgtacggacgtacgttacggactacggtaccgggtaacccgggttcccccgacgttaccggtaaccggtcccggttacccggggttaccgggggtaccttaccccgttgggtacccctttaaccggtccggttcccggtacccggtacccgggttaccggtccgtacccgtaggtaacgttccggttaactaccgtaccgtaccgtaacgacgttcccgaaaccgttcctttccccgttccctttcccgttcccgttgttaccgcgttaaccgttctccggttacggtaccggactaccgtccggtaccctaccaaccgttcgtaccgtaggtttcgggaaccgtacgtacgtaacgtaaacgtaaccgttaacttttaaagttaccgtttaagtttaaccggttgtttaaccacgttaacgtaccggtaacgtaaaaccccggg

SEQ ID NO: 17474 - DNA, 891 bp, Homo sapiens
  misc_feature: GYAE6OF02FR4DN.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtctgggctgaactgggttttccttgttgcttattttaaaaggtgtccactgtgaggtgcaactggtggaggtcgggggggtagtggtaggtacgggccgggggggtccctggagactctcagtggtcgcgagggtcgtggtacttacaacgtttttacgatttagtcggtactaagtcggacccgttgggggtaccccgacccgtaaacggtcccgtacccgggtaacggggggaacggggggtccggtaggggttaacggggttcgggggttccgtttccggttcgggtttacccgttaagggttaaacggtttggggtaaaaggtttggggttaaggtaaagtttaaagggttaatttaaggttaacgtttaaggttacggacgtaacgggttccgttcgtttacggggtcggggaccgggggtaccgtaacgtttcccgaacccgttaacgttccccttaccggaaagggtaaccgaacccgtaaaacccggaccccgtaaaaacggtacccctttaccccgtttgttttacccgtaagtaaccttaaagtcgtaaacttaaaggtttggaaggtaagggaacgggtaaacgtaccgtaccggttacccttttaatttacgttttcgtacggtacggtacggaacggtaccggtcccccggttagggaacccgtaggttaacccggttcggttacggaacccttttaacccgtttaacgttaagtttaggttacgggttaaccgg

SEQ ID NO: 17475 - DNA, 882 bp, Homo sapiens
  misc_feature: GYAE6OF02GUYPJ.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactacgccatggagtctgggctgaacttgggttttccttgttgcttaagttttaaaaggtgtccactgtgaggtgcaacgtggtggacggtcggggggaggtggtacggtacggggcccggggggggttcccctaggacgaccgttccgtacagtggtcgacgtacggggttctagggtattaccgtaacttttacgaacttaagtggtcagttcggaccgttgggtaccccgactaacgccgtaccggaagggggtaacgggcgtaggggtacgggttgggttaccgttccggttagggttcggttacggtaagtttaggggaagttgggtacgaagtttaaggtaataggttaatttaagtcgcggtacggtcgtaccgggtaggtacgggtagggggaccctttagtttacccaccctaacgtcccgttacgtaacggacgtaaaccgtaaacccgaccgaaaacccgttaacccgttccccgtttaggttttaccctaaccggtaactaaaaccggtacggttaaacttaaaggttttaaggaacggtaaacgggtacgggtaaacgccgttaaccgggttaaccttttacggttttaaccgtttacgtttaacgggttccgtaacgggtaacggtccccgggtaccccgttacggggttaactaaaccggttaaccggtttacggtaacccggttaacctttaacccgttaacggttttaagtttaccggttaagggttaacccggg

SEQ ID NO: 17476 - DNA, 701 bp, Homo sapiens
  misc_feature: GYAE6OF02JZ40E.12.33.C11.1.454.CMB.1.raw
  modified_base (551)..(551): a, c, t, g, unknown or other
  misc_feature (551)..(551): n is a, c, g, or t
tcagatacgacgtacacgaccggtgctcgatttagagtgagctcgttgggtttggggagctctgggagaggagccccagccctgagattcccacgtgtttccatccagtgatcagcactgaacacagtaggactcgccatggagtctgggctgaaccttgggttttcctgttgcttatttaaaggtgtccactgtgaggtgcaactggtggaggtcggggggagtgtacggtacgggccggggggtccctggagactcgtcagtgtgacgtagggtctgggtactttcctaaacgttttacgagtttagtcggactacgtacggtacccgttcggggtacccaccgtaaacggtccctaccgggaaggggaacggggtccgtgggtacgggttcgggtctcggttggtcctaggtagttaggaagtgggttagagtagttaagtagtaactttagcgacgtaggtacctgtgggtcggacgggtacctagttacccacgtataccgtacgaagactaacgaaccgacaaaccgtacctccgttgtacgtanaacgtaacgagtactaagttcgaaggtagagaaccgtcgaaccttacgttaattccgttaggcgttaccggagtcggacccgtccgacggactaaacggttacggtaaccgttaccgtacgtacccttaaggtaattcggtaggttacgg

SEQ ID NO: 17477 - DNA, 783 bp, Homo sapiens
  misc_feature: GYAE6OF02FNGM9.12.33.C11.1.454.CMB.1.raw
  modified_base (254)..(254): a, c, t, g, unknown or other
  misc_feature (254)..(254): n is a, c, g, or t
  modified_base (429)..(429): a, c, t, g, unknown or other
  misc_feature (429)..(429): n is a, c, g, or t
tcagatacgacgtacacgaccggtgctcgatttagagtgagctcgttgggtttgggggagctctgggagaggagccccagccctgagattcccacgtgtttccatccagtgatcagcactgaacacagaggactcgccatggagtctgggctgaactgggttttccttgttgcttaattttaaaaggtgtccactgtggaggtgcaactggtggaggtcggggggaggtgtaggtacgggccgggggggtcccnggacgactcgtctatggtgcgaggtcgtggtattctaacttttacgatttagtggctatcgacccgtgggtcccgtacagtcgtccggaagggaggggcctgggaggtgggtctagtcgggtctaggtacgttaggaactgggtagtacgttaaggtattaggtatttagtacgngtacggtctaccgttgggtacgggaccgggggtacctacggtttaccaacccgtaacgttcccgtaacgagggtaaccgtaaacccggaaaccgaacccgggaaacgttaaccccgtttcccggtttagtttcccgtacgggaacctaaggttccggtaaacttaacggtttaggaaccgaaggggtaaaggtaaaccggaccgttaaaccggttaccgtttaactttaaacgttttccgtagggtttcgaccggtaacgtacccggtacccggttccggaccgtaaacgggtcggtttaccgacgggttaacctaccggtttaacttaacgggttttatgggtttaaacccgg

SEQ ID NO: 17478 - DNA, 938 bp, Homo sapiens
  misc_feature: GYAE6OF02IZ04G.12.33.C11.1.454.CMB.1.raw
tcagatacgacgtacacgaccggtgctcgatttagagtgagctcgttgggtttggggagctctgggagaggagccccagccctgagattcccacgtgtttccatccagtgatcagcactgaacacagaggactcgccatggagtcgtgggctagtaacgttggggtttttccttggtttgtactttaagtttttaaaagggtcgtaccgtacgttgggtgagggtgacctaacgtggggtgggagggtcgggggggtaggttggtaacgggtaccgggggtccccgggggggtccctaggacgtaccgttactacgagttggtcgacggtacgggttcgaggtaactttaccgttaaacttttaggactttagtcggtactagtacgtccggtcggggtcccacaacggtccgtaccggaaggggggacggggtcgttaggggtaacgggttcggggtttccttagggttacggttacgttaggttaaggttagggtaagttgggtaagtaacggttaaagttaaggtttaacggttaatttagcgggtaaccgtacgggttacgttacggtttaggggtaccggggaaccgggggttaccctttaaccgtaccggaaaccctttaccgttacccggtaaccggtaaaccgggtaacggaaacccggaaaccccggtaaacccggtaaaaccgtttaaccccgttacccggtttttacggtttacgtttaacccgggtactttaaacgggttaacgtaaccgttttaaagttaacggggaagttaaacgggaaaggggaaacccttacgggtaccttaaaccggttttacgtttacttttacgggttaggtacggtaccgttacggtacccgtccgggttaccgacggttaaagtcggtacgtacgttaactaccttaagtttatacggtaggtacgg

SEQ ID NO: 17479 - DNA, 780 bp, Homo sapiens
  misc_feature: GYAE6OF02F2O51.12.33.C11.1.454.CMB.1.raw
tcagatacgacgtacacgaccggtgctcgatttagagtgagctcgttgggtttggggagagagaaatacattccctccaggcaaatctatgctgcgctggtctgacctgggaccctggggacattcgccctgtgctgagttactaagatgagccagccctgcagctgtgctcacgcctcgccccatcgccctgcctgattgatttgactagtcgttcacgagccgaacagccttcccgtcgacccctagaacgttacctttttaagtcgggtcgtcggttccgaccacccgtgtcgcgagggacgtcgacgttcctacgtagtcgacggacctaccgaacgtcgaacgtacggactacgtcggacccgggttccccccgcgtacgacggtccgttacccggtcggggtcccttcccggttcgtaccgttacccgtccggtacggtccccgtccggtacgggtccgtaacccgaggtgtacggtacgaaccgtaccgtctaaacggtccgttaccgaaccccgtttacggtttaccccttcccccttttaccccgttcccgttccgttcgtccgtacctccgtttcggtacgggttaaccgggaactaccgaaccggtcccttaacgaaccccgtaagtccgtacgttccgggtaccggtacaaacggtaccggtaaacgtaacttttaaaccctttaaacgtttaaacgtttttaaacgtttaacggttaacggtttactaaccggttaaacccaaacgtaaaaccgggtaaaaccccgg

SEQ ID NO: 17480 - DNA, 613 bp, Homo sapiens
  misc_feature: GYAE6OF02H8RUX.12.33.C11.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (605)..(612): a, c, t, g, unknown or other
  misc_feature (605)..(612): n is a, c, g, or t
tcagatacgacgtacacgaccggtgctcgatttagagtgagctcgttgggtctggattcaacttttacgattatggcatgacctgggtccgccaagctccaggggaagggggctggagtgggtctctggtctgaattggaatgggtgatagtatagtattatgcaggtctctggtggaggggccgtattccaccattcnccagagacaacgccaagacctccttgtttctnacaaagtggaactaagtttagaggagaaggaagacgaccggtctttaattnttttactggtggtcgaggacgcccgtcggacaggtaagtcgtaggactaaccgttactaatttagtaggtatgggtcgtcggtcggggaccgaacgggaccgacggtacagtccgtctcctcacgtcctaccaccggaacgccaacgttccgtcccttaccccgtcggccctacctcctaccgaacgacgccaccgtcggtcggggcagacgggccgcgtcggtcggcgtccggttgacgtaacggtacctaccgttccttacgtacgtctcgtgacggtcggcgtaggacggtacggcgaccgtatcggatcgngtancgannnnnnnnc

SEQ ID NO: 17481 - DNA, 748 bp, Homo sapiens
  misc_feature: GYAE6OF02FQMH8.12.33.C11.1.454.CMB.1.raw
  modified_base (328)..(328): a, c, t, g, unknown or other
  misc_feature (328)..(328): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagatacgacgtacacgaccggtgctcgatttagagtgagctcgttgggtttgggggagctctgggagaggagccccagccctgagattcccacgtgtttccatccagtgatcagcactgaacacagaggactcgcagtggagtcgtgggctagaacgttgggtttttcctgttgcttaagtttaaaaggtgtccatggtgaggtgacaattgggtggagggtcggggggaggttggtaggtacggggtccgggggggtcctggtagaccttcgtcctagtggtgacggtgggtcgtaggtattctaaacgttttagatttagcgtnactcggtaccgtgggtcccgaccgtaaggccgttccggaagggggaaggggtcgtaggtagggtcgggtccgttcgtcgggttctagtaagtttaggggaattggtagtaagttaagttnaagtagttanggcgaggtccttagnggtacgggacggggcctaacgttccgacctacttccaccgtaaggtacgaaccgaaacggaccctaaacggtaaccccttaccggttgtttacagttaacaaagtacgtaacgtttaaggttagaaggtaacggagggaaactcggtaaccgttacgtttaacgttagttttcgtacggtggtaccgacggtaacccgtcccgtaacgggacctaacggtagttacccgtacggttaccttaaccgtaacgttacggtttacgtggttaaccggg

SEQ ID NO: 17482 - DNA, 494 bp, Homo sapiens
  misc_feature: GYAE6OF01CWWOU.11.63.F08.1.454.CMB.1.raw
  modified_base (436)..(436): a, c, t, g, unknown or other
  misc_feature (436)..(436): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttggagtggatgggacggatcaaccctaatagtggtggcaacaaactatgcacagaagtttgaggcagggtcatcatgaccagggacacgtccatacagcacagcctacatggagctgagcgaggcgtgacgatcngacgacgacggccgtagtagtactgtcgcgagagagtaaagggattgtgatgtaaccg

SEQ ID NO: 17483 - DNA, 491 bp, Homo sapiens
  misc_feature: GYAE6OF01DRY2Y.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgggagcccactcccaggtgcagttggtgcagtctggggctgaggtgaagaagcctggggcctcagtgaaggtctcctgcaaggcttctggatacagcttcaccggctactatatgcactgggtgcgacaggccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtagttactgtgcgagagagtaaaggggattggtgagtgtaaccg

SEQ ID NO: 17484 - DNA, 500 bp, Homo sapiens
  misc_feature: GYAE6OF01D2R39.11.63.F08.1.454.CMB.1.raw
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacgatcaaccctaatagtggtggcaacaaactatgcacagaagtttgagggcagggtcatcatgacagggacacgtccatcagcacagacctanatggagctgaggcggagtcgtacgacgacncgtagacgacacggcgtagtattacgtgtcgcgagaagtagtaaagggattgngtagtacg

SEQ ID NO: 17485 - DNA, 489 bp, Homo sapiens
  misc_feature: GYAE6OF01DMKY7.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgaggcagggtcatcatgaccagggacacgtcatcagcacagcctacatggagctgagcgaggctagacatctgacgacaccggcgtgtacttatgtgacgagagtaagtaaaggggattgtgataacg

SEQ ID NO: 17486 - DNA, 509 bp, Homo sapiens
  misc_feature: GYAE6OF01DR84K.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaacctaagtagtggtggacacgaaactatgcacagtaagtttggagggcagggtcatcatagacgagggacacgtcatcagcacacgacctacagtcggagcgtagagacagggctagacatcgtagaccgacgcggccgtagtattactggtgcgagacgtaagtaaagggtattggtgtataacg

SEQ ID NO: 17487 - DNA, 508 bp, Homo sapiens
  misc_feature: GYAE6OF01BY9S4.11.63.F08.1.454.CMB.1.raw
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacacggcccctggacaagggcttgagtggagtgggacggatcaaccctaataggtggtggacacaaactatgcactagaagtttggagggcagggtcatcatgaccagggacacgtcatcagcacacgcctacagtgganctagagcgagggtctgaacngtacgtgaccgacgaccggtcgtagtattactggtgacgagagtagtaagggattggtgtagtacg

SEQ ID NO: 17488 - DNA, 525 bp, Homo sapiens
  misc_feature: GYAE6OF01B80MJ.11.63.F08.1.454.CMB.1.raw
  modified_base (286)..(286): a, c, t, g, unknown or other
  misc_feature (286)..(286): n is a, c, g, or t
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacnggcccctggacagggcttggagtggagtgggacggatccaaccctaatagtggtgcaacaaactatgcacagtaagtttgagggcagggtacatcagtacgacgagggacacgtccatcagcacacgcctacagtaggacgctggacgcgaggtcgtagacgatactacggacgacgacggccgtagtacttagtggngtacgaggagtaaggtaaagggattaggngtaagttaacgg

SEQ ID NO: 17489 - DNA, 526 bp, Homo sapiens
  misc_feature: GYAE6OF01DBF93.11.63.F08.1.454.CMB.1.raw
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (510)..(510): a, c, t, g, unknown or other
  misc_feature (510)..(510): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctggaggtgaagaagccgtggggcctcagtgaaggtctcctgcaaggcttctggatacagcttcaccggctactatatgcactgggtgcgacacggcccctggacgaagggcttggaggtggagtggggacggataccaaccgtaagtaggtggtggacaacaaactagtagcacgagtaagtttggaggcgagggtcatcatcgacgagggacacgtccatcagcacagaccctanagtggagctgagcgaggtcngacagtacngacgacgacggtcgtagtactacgtggtcgagaagagaaggttaaagggnttaggtagtagtaacg

SEQ ID NO: 17490 - DNA, 549 bp, Homo sapiens
  misc_feature: GYAE6OF01CKHKK.11.63.F08.1.454.CMB.1.raw
  modified_base (245)..(245): a, c, t, g, unknown or other
  misc_feature (245)..(245): n is a, c, g, or t
  modified_base (530)..(530): a, c, t, g, unknown or other
  misc_feature (530)..(530): n is a, c, g, or t
  modified_base (538)..(538): a, c, t, g, unknown or other
  misc_feature (538)..(538): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcgagtgaaggtctcctgcaaggcttcnggatacagcttcaccggctactatatgcacgtgggtgcgacaggcccctggacgaaggcttgagtggagtgggacggataccaacctaatacggtggtacgcaacaaactatggacaacgtagtaaagtttggagggcgagggtcatacagtcgaccgaagggacacgtaccatcagcaacgcgacctacagtcggagcgtagagcgaagggtctagacagtcctacggacgacgtcgggtcgtagttacttagtgtggacgaaggaggtaaaggtaaaggggtnttagggtnaagttaaccgg

SEQ ID NO: 17491 - DNA, 706 bp, Homo sapiens
  misc_feature: GYAE6OF01AC4NR.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctcgagtgaaggtctcctgcaaggtctcgtggatacagtcttcaccggctactatacgtgcacgtggtcgcgacgacggcccctggacgagggtcttggagtggagtgggacgtataccgaaaccctaagtacggtggtacggacaaactaaactagtcgacctaagtaaggtaacggtttaggaacggggtctacggggtactagtacgacgtacggaacccggaaggggtaaccctaaccggtacccgaacgtaccgaacggacctaaccgaaccgtaccctaacgaggttacggaccgtacgtacgggaacgaccggtagggtaccgtacgaactacgttacgtaaccgggaccggtaacccgtacccggggttaccgttaacgggtttaactttaccgggtacgggttcggaaccgggtaaaggtaaacgggtaaacgggttaaaagggggttagtttagggtaacggttaagttaaacccggg

SEQ ID NO: 17492 - DNA, 540 bp, Homo sapiens
  misc_feature: GYAE6OF01CTW9B.11.63.F08.1.454.CMB.1.raw
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (516)..(516): a, c, t, g, unknown or other
  misc_feature (516)..(516): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacgacggcccctggacaagggcttgagtggatggggacgatcaaccctaagtagtggtggcaacaaactatgacaacgagtagtttggaaggcgagggtcattcgagtagaccgagggacacgtccaatcagcacacgacctacagtggancgtagacgngacggctgacatacgtgaccgacgacggtccgtgttacgttacgtgtacggcgtaggaagaaggtaaacggggtnttaggtagtaagtacggtaaaccg

SEQ ID NO: 17493 - DNA, 629 bp, Homo sapiens
  misc_feature: GYAE6OF01C0M2X.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctcgagtgaaggtctcctgcaaggtcttctggatacagtcttcaccggctactatatgcacgtgggtgcgacacggccccgtggacgaagggcttggaggtggagtgggacgataccaacctaagtaggtggtaggacaactaaactagtcgacaacgagtaaggtttggagggacgaggggtacagtcgaagtacggaaccgaggggacctaccggtaccaataccgagccaacgacgtaccctaacgagtagggacgcgtaggacggaccggagggtccgagaacgtacgtccgtaacggaaccggtaccgaccgggttaccgtaggttaaccgttacggtcgggtacggacggtaaggaaacggtaaagggttaaacgggggtatttacgggtagtaagttaaaccgg

SEQ ID NO: 17494 - DNA, 530 bp, Homo sapiens
  misc_feature: GYAE6OF01C50V3.11.63.F08.1.454.CMB.1.raw
tcagcgagagataccacgaccggtgctcgatttagcgatcgtataaggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacacggcccctggacgaagggcttggagtggagtgggacggactacaacctaagtagtggtgacaacaaactatgacacgagtaagttggagggcagggtcagtcagtacgacgaggacacgtcatcagcacacgaccctagagtcggagcgtagacgcgaggtcgtagacgacgtcgtagtacggaccgacggtcgtacgtagtagtggtgacgtagaggtaagtaaagggtattggagtgttaacg

SEQ ID NO: 17495 - DNA, 620 bp, Homo sapiens
  misc_feature: GYAE6OF01AN9ZQ.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagccgtggggcctcgagtgaaggtctcctgcaaggcttctggatacagtcttcaccggctactatatgctacgtgggtcgcgacgacggccccgtaggacgagggtctggaggtggagtgggacgatacaacctataggtggtaggacaacgaaactgtacgacacgaagtaaggtttggaacgggacgtaggggtactagtacagtacgaaccgagggacctacgtacctagtaccgagaccaacgacgaccctacagtcggacgcgtagacgtacgacgggtactagaacgtacgtacgtacggaacccggaccgtaccgggtccggttaagttacgtttacggtaggtcggaacggaaggtaaagggttaacgggttaaaggggtagtttaggtaagtaaggttaaacccgg

SEQ ID NO: 17496 - DNA, 592 bp, Homo sapiens
  misc_feature: GYAE6OF01EGIL5.11.63.F08.1.454.CMB.1.raw
  modified_base (251)..(251): a, c, t, g, unknown or other
  misc_feature (251)..(251): n is a, c, g, or t
  modified_base (549)..(549): a, c, t, g, unknown or other
  misc_feature (549)..(549): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctggaggtagaagaagccgtggggcctcgagtgaaggtctccgtgcgaaggcttcgnggtatacgagtccttccgaccgtctactatatcgctacgtgggtcgacgacgaccggcccgtaggacgaagggtctggagtggagtcggggacgataccgaaccgtaagtggtgggtacgacaacaaactgtcgacgacgtaaggtaagttgggaacgggcgtagggtacagtacgtagtacgaccgaacgggaccaccgtacactacgacgacacgacgtaccataggaggagcgtaggacgacgaggtcgacgactacgtacgacgacgaccgaccggtacgtaggttacttacgnggtcgacgtagaaggtaagtaagggtagtaggtagagttaacg

SEQ ID NO: 17497 - DNA, 534 bp, Homo sapiens
  misc_feature: GYAE6OF01EKRJ2.11.63.F08.1.454.CMB.1.raw
  modified_base (346)..(346): a, c, t, g, unknown or other
  misc_feature (346)..(346): n is a, c, g, or t
  modified_base (415)..(415): a, c, t, g, unknown or other
  misc_feature (415)..(415): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacacggccctggacaagggcttgagtgagtgggacgatacaacctaatagtggtggcacaaactanagcacagtaagtttggagggcagggtcatcatgaccagggacacgtccatcagcacagcctacatgganctagagcaggctagactatcgtagaccggacgaccgggcccgtaggttacttacgtggtcggacggaggaaggtaaggttaaaagggggtatttagggtacggtaatacggttaacccg

SEQ ID NO: 17498 - DNA, 505 bp, Homo sapiens
  misc_feature: GYAE6OF01AO2V0.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggctgagtggatgggacgatcaaccctatagtggtggcacaaactatgcacagaagtttgagggcagggtcatcatgacgagggacacgtcatcagcacacgcctacagtggagctaggagcgaggctagacatcgagaccgacgaccggtccgtgtacttacgtgtggacgagaggtaagtaagggtattaggtgtagttaaccg

SEQ ID NO: 17499 - DNA, 595 bp, Homo sapiens
  misc_feature: GYAE6OF01A0OV6.11.63.F08.1.454.CMB.1.raw
  modified_base (467)..(467): a, c, t, g, unknown or other
  misc_feature (467)..(467): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacgacggcccctggacagggtctggagtggagtgggacggactaccaacccgtaagtaggtggtaggacaacaaactatagacaacgaagtaaacggtttggaagggcgtagggtacagtcgagtacgaaccgacggggaccaccgtacctagtaccgaagccaacacgtacctaacagtgggacncgtaggacgcgacggtctacgactacgtacgtagaacccggacgaccgggtcgtacggttacgttcgtggtcggacggaaggtaaggtaacgggtaaagggtagttaggtagtaagttgttaaacccg

SEQ ID NO: 17500 - DNA, 596 bp, Homo sapiens
  misc_feature: GYAE6OF01CRAPI.11.63.F08.1.454.CMB.1.raw
  modified_base (246)..(246): a, c, t, g, unknown or other
  misc_feature (246)..(246): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctggaggtgaagagccgtggggcctcagtgaaggtctcctgcaggcttcgnggatacagctcgaccggctactatatgcacgtggggtgaccggaccgacggcccccgtagggaccgaagggtcgttggaggtgggaggtcggggacggtactaccgaaaccctaagtaggtgggtacggacaaacgtaactagtgacaacgagtaaggtttggagggtacgagggtcagtcagtacgacgagggaccacgtccagcacgcaacacgccagtagtacggagcgtaggacggcgaggtctacgactacgtcgtacggaacgaccgacggtccggtagttacgttacgtggtcgacggaaggtagtaaacgggttaagggtagttcggtagtaagttaaccgg

SEQ ID NO: 17501 - DNA, 872 bp, Homo sapiens
  misc_feature: GYAE6OF01BXOZ8.11.63.F08.1.454.CMB.1.raw
  modified_base (355)..(355): a, c, t, g, unknown or other
  misc_feature (355)..(355): n is a, c, g, or t
  modified_base (462)..(462): a, c, t, g, unknown or other
  misc_feature (462)..(462): n is a, c, g, or t
tcagcgagagataccacgaccggtgctcgatttagcgatcgtataagggggcaggtcgaacccagcaaccactagtcctgtccgtacctagaggaaatccccctgagacgcttccgttccttccaccagtcggtacttggaccgtggacggatccttcttcttggtgggcaagcagccacgacggacgcccactcccaaggtcgctaggtttggtgctacgtccgtagggggctggaggtcgaaacgaacgcctggggcctcggacgtggaacggtctccgtggtcgaaggcttctaggtactaccgaggccttcgaaccggacttaacgttagtactggcctaccgtggggtcnccgtacacggtccccttgggacgtaagggccttaggaggtcgggagttggggacggtactacgtaaacccgttaagttacggtggtgggacctaacgtaaaccgttntcggtacgaacgaggttaaacggttttcggaacggggtcctaacggggttacccaagttccgaagttacggaacccggtaacggggtaaccgtaacccggttaacccgtaacgttaccgaaacggttaccgttaacccgtacggtaaccccgttttaaccgtaacgtttacggggtaacgtaccgttacggaaacggttccgtaacggggtaccttaacgggtaaccgtacccggtttaccggtacggggtaaacccgggtaacccgggaacccgggtacccggggttaacggttaaaccgggtttaaccggttacgggtaaccggtaacgggtaaacgggtaacgggttaaacgggttaaacgggggttatttaccgggttaacgtaaacgtttacgggtttaaccccg

SEQ ID NO: 17502 - DNA, 733 bp, Homo sapiens
  misc_feature: GYAE6OF01CX78K.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttccggtggcagcagccacaggacgcccactcccaggtgcagttggtgcagtctggggctgaggtgaagaagccgtggggcctcgagtgaaggtctccgtgcaaggcttcgtggatacagcttcaccggctactatatgcacgtgggtgcggacacggcccctaggaccaagggcttggaggtggagtgggacgataccgaacctaagtaggtggtggacaactaaactagtgactaacgaaggtaacggtttggaacgggtcgtaaggggtacaacgtacgaacgtcggaaacccggaaggggaaccctaaccggtacctaaacgtacccgaacggacctaaccgaaccggtacccgtaaccgtaacggttacggggaacggtaccgttagggaaccggtccggtaacgggtacccgttacggtaacccgtaacgttccggttaaccgggaaacccggtaaccggacccggggttacccggttacggttaacgttttaaccggtgggttacgggaccgggtaaaacgggtaagggtaaacggggttaaaaaggggggttatttaacggggttaggtaaaggtttaaacccggg

SEQ ID NO: 17503 - DNA, 618 bp, Homo sapiens
  misc_feature: GYAE6OF01BHXGC.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcagtgaaggtctcctgcaaggcttctggatacagcttcaccggctactatatgcacgtgggtgcgacgacggccccgtggacgaagggcttggaggtggagtgggacggatcgaaacccgtaagtaggtggtaggacaacaaactagtgacaacgaggtaacgtttggagggtcgagggtacagtcgaagtcgaacgaagggaccaccgtaccactaccgacgtacacgacgacccttaacagtgggaagtcgtaggaacgcgacgggtactacgaacgacgtccgtacggacccggaacgtacccgggacccgttaggtacgtttacgtcgggtaggaccggtaaggaacggtaaagggttaaacggggtagtttcggtaagggttaagttaaaccgg

SEQ ID NO: 17504 - DNA, 619 bp, Homo sapiens
  misc_feature: GYAE6OF01ALW9N.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagccgtggggcctcagtgaaggtctcctgacaggcttcgtggatacgagtcttcaccggctactatatgcacgtgggtgacgacgacggcccgtggacgagggtctggaggtggagtgggacgataccgaacctaagtaggtggtcggacaacgaaactgtacgacacgtagtaaggtttaggacgggcgtaagggtactacgtacgacgtcggaaccgtacggggactaccgtccaacgttaccgacgccaaccgtaccgtacccgtacgtaaggtcggacgtacgtaggacggacgacgggtctacgaacgtacgtcgaacggtaccgacgtaccgggtccgttagttacttacgtgggtacgacgtaaggtacgtaaagggtaacggggtattcgggtagtagttaaccgg

SEQ ID NO: 17505 - DNA, 671 bp, Homo sapiens
  misc_feature: GYAE6OF01CVLOA.11.63.F08.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctnagtgagtctctgcagctctgatacagcttcgaccggctactatatgctacgtgggtcncgtacgacggccccgtggacgaagggtcttaggaggtggagtcggggacgataccgaaaccgtaagtaggtggtacggacaacgtaaactgtacgacaagtaaggtaaggttttgggaagggtccgtaaggggtacctaagtacgtaacggttaccggaaccggtaacggggaccctaacccggtacctaacgtaccgacgacccgtaaccgacgtacccgtaacgtacggtcgggaacgtccgtaaggcgaccggaggtaccgtagaacctacgttacgtacggaaccggtaccggtaccgggtaccgttagttaaccgtttacgtgggtacggacggaaaggtaaggtaagggttaaaggggttattagggacgtaagtaacgttaacccgg

SEQ ID NO: 17506 - DNA, 571 bp, Homo sapiens
  misc_feature: GYAE6OF01EFQPX.11.63.F08.1.454.CMB.1.raw
  modified_base (218)..(218): a, c, t, g, unknown or other
  misc_feature (218)..(218): n is a, c, g, or t
  modified_base (527)..(527): a, c, t, g, unknown or other
  misc_feature (527)..(527): n is a, c, g, or t
  modified_base (555)..(555): a, c, t, g, unknown or other
  misc_feature (555)..(555): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagcctggggcctnagtgaaggtctcctgcaaggtcttcgtggatacagcttcaccggtctacgtatatgctacgtgggtcgcgaccgacgggtcccctagggaacgaaggggtcttaggaggtaggagtggggaacggaacgtaccgaaacccgtaagtacggtggtaggacaacaaactatgacacagtagttggaggcagggtcatcagtcgacgaggacacgtcatacagacacacgacctacgagttcgacgtcgtagacggtacgagggtctacggaacacgtacgtacgacgacgaccggtccgtagtacgttagnggtcgaggtagaaggtaaggtaagggtnttagtgtagttaaccg

SEQ ID NO: 17507 - DNA, 558 bp, Homo sapiens
  misc_feature: GYAE6OF01BIBH6.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctggaggtgaagaagcctggggcctcgagtgaaggtctcctgcaaggcttctggatacagcttcaccggctactatatgcagtgggtgcgacgacggccccgtggacgaagggcttggagtggagtgggacggatcaaccctagtagtggtaggacaacaaactatggacacgaagtagtttggagggtcgagggtcatcagtgacgagggacacgtccatcgagacacgagacctacagtggacgtctaggacgacgaggcgtaggacacgtacgtacgaccgacgaccggtccggttagttacgttagtggtcggacggagaacggtaaggtaaaggggtagttaggtagtaagttaaccg

SEQ ID NO: 17508 - DNA, 597 bp, Homo sapiens
  misc_feature: GYAE6OF01BN8H3.11.63.F08.1.454.CMB.1.raw
  modified_base (367)..(367): a, c, t, g, unknown or other
  misc_feature (367)..(367): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcagtgaaggtctccgtgcaaggcttctggatacagcttccaccggtctactatagtgactacgtgggtcgcgacgaccggcccgtggacgaagggcttggagtggagtgggacgatcaaaccctaataggtggtacggcaacaaactntcgacactaagtagtttggagggtacgagggtcatacgacgtcgaaccgagggaccaacggtccaagtccagcctaacaccggcctactagcgggacgtctggaacgcgaagggtcctacggaactagtcgtacggacgaccggtcccggtacggttacgttatttacggcggttggaccgtaaggaaggttaaacggtaaaggggtacttaggtaggtaacgttaaccg

SEQ ID NO: 17509 - DNA, 637 bp, Homo sapiens
  misc_feature: GYAE6OF01DY5K3.11.63.F08.1.454.CMB.1.raw
  modified_base (248)..(248): a, c, t, g, unknown or other
  misc_feature (248)..(248): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctggaggtgaagaagccgtggggcctcagtgaaggtctcctgcaaggcttcgnggatacagcttcaccggctactatatgcacgtgggtgcgacgacgggcccctggacgaagggtcttggagtggagtgggacgataccaacctaagtaggtggtaggaccaaacaaacgtagtacgacaacgaaggtaaggtttggaagggtcgtaaggggttacagttacgaagtacggaaccgaaggggaaccctaaccgtaccaacgtaccgacgacctaacgaaccgtacctaacgtagtagggacgtacgtaggacgacgaacggtcgtacgaactacgtacgtacggaacccgacggacccggtccgttacgttacgttacgttggtcggaccgaggaaaggtaaacgggtaaaggggttatttagggaagtaacgttaaccgg

SEQ ID NO: 17510 - DNA, 581 bp, Homo sapiens
  misc_feature: GYAE6OF01BX1GF.11.63.F08.1.454.CMB.1.raw
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
  modified_base (557)..(557): a, c, t, g, unknown or other
  misc_feature (557)..(557): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcaggttggtgctagtcgtggggctgaggtgaagaagccgtggggcctcagtgaaggtctcctgcaaggtcttcgtggatacagtcttcgaccggtctactatatgcacgtgggtgcgacacggcccctaggaccgaagggcttaggagtggacgtggggacggataccgaaccttaagtagtggtggctaacaaactnacgacaacgagtaagttggaggacgagggtcatcatcgacgacgggacacgtacatcacgcacgtacgccctaacngtacggactacgtggaacgtcggaggcgtacgaacgtatcgaacggacgtaaccggaccggtacgtacgttacgttacgtggtcgacggaggaagtaagtaaacggggtnttaggtagtaacgtagttaacccg

SEQ ID NO: 17511 - DNA, 986 bp, Homo sapiens
  misc_feature: GYAE6OF01A3P1G.11.63.F08.1.454.CMB.1.raw
  modified_base (163)..(163): a, c, t, g, unknown or other
  misc_feature (163)..(163): n is a, c, g, or t
  modified_base (822)..(822): a, c, t, g, unknown or other
  misc_feature (822)..(822): n is a, c, g, or t
tcagcgagagataccacgaccggtgctcgatttagcgatcgtataagggggagcatcacccagcaactacatctgtcctctagagaatcccctgagagctccgttcctcaccatggactggacctggaggatcctcttcttggtggcagcagccacagggacncccacctcccgaggtcgacgtaggttgggtcgacgtacggttcggtcggggtcgtagggtagggtaggaaacggaaccgtccggggtcggggtccctacggtaggtacgggtaaccggttcccttacccgttcggaaccggtaacgggttcctttacggtacggtaacttaacgtaccggttaccctttacccggaacccggttaacctttaaccttaagttaacggtccgtaccggtttaaccggggttgggggttaccgaaccccggtaaccggtacccccggggtccccggttaacggggaaaccgggttaacggggttccgtttacggggtaaggggtacggggtaacggggtaccggggggtaaacccggttaacctaaccccggtaaaaacccggtttaagggttaacggggttacggggtaaccggtaaccgtaaaacccgttaaaacttaaccgggtacggtaacccgaaacggttaaacgggtttaaagggtttacggggaaccgggtacgggtaaccgggtactacgttaaccggtaacggtaaccggaaccgggaaccggggtaaccctaccggtaaccgtaactaccggacccggtaaactacccggtaaccgtaccctaacggtagggtaccggaacgttaccggnggaaccggtaccgaccgggttacgtaacggaccgttacgtccggaaccggaaacccggtcccgggtaccggtaccgttaacgttacggttcggacgggttacgaacgggaagtaacggggttaaacgggtttagtacgggttaagtaccgttacgttaacccgg

SEQ ID NO: 17512 - DNA, 591 bp, Homo sapiens
  misc_feature: GYAE6OF01EQNVV.11.63.F08.1.454.CMB.1.raw
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctggaggtgaagagcctggggcctcgagtgaaggtctcctgcaaggcttcgtggatacagtccttacaccggtctactatatgcacgtggtgcgacaggccccgtggaccgaagggctttcggaggtggagtggggacgataccaaccctaagtacgtggaggacaacaaactatacgacacagtaacgttggaacggctagggtcaatcatacgaccgaggacacgtccaatcagcaacgacgacctacacgtaggacgcgtacggacacggacggacgtagacctatccgaggtaccgacgaccgggtaccgttagtaagtttaacgtcgtacggtacggaaggtaaggtaaaggttaaagggggtaattagggtacgtaacgttaacggttaaccg

SEQ ID NO: 17513 - DNA, 534 bp, Homo sapiens
  misc_feature: GYAE6OF01BZWHB.11.63.F08.1.454.CMB.1.raw
  modified_base (437)..(437): a, c, t, g, unknown or other
  misc_feature (437)..(437): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcagtgaaggtctcctgcaaggcttctggatacagcttcaccggctactatatgcactgggtgcgacacggcccctggacgaagggtctggagtggagtgggacgatacaaccctaagtagtggtgacacaaactatgcaacgtagtagtttggagggctagggtcatcagtcgaccgtagggacctacgtccagtcagcacgagaccagagtggacgntaggacgcgaggtctagactctcgagacgacgccggtccgttagtacgttgtaggtcgacgaggtaagaagttaaggggtattggtagtagtaacgg

SEQ ID NO: 17514 - DNA, 631 bp, Homo sapiens
  misc_feature: GYAE6OF01C9CFH.11.63.F08.1.454.CMB.1.raw
  modified_base (519)..(519): a, c, t, g, unknown or other
  misc_feature (519)..(519): n is a, c, g, or t
  modified_base (619)..(619): a, c, t, g, unknown or other
  misc_feature (619)..(619): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctggaggtgaagagccgtggggcctcgagtgaaggtctcgtgcgaggtcttcgaggatacgacgtccttacgacccggtctacttaatatcgcctacggtgggtcgaccgaccgacggccccgtagggaacgagggtcttaggaggtaggagtgggacgtactaccgaaaccgttaagtacggtgggtacgaccaaacgtaaactagtcgacaacgtaggttaacggtttggacgggacgagggttacagttacgaagtacggaacccgaaggggaacctacggttaccaagtacgacgaccaacacgtacctagagtggacgngtaggacgcggagtcgtagacgtctacgacgaccgtacgaccggtcgtagtacgttagtaggtacggacgaagtaacggtaaggttaagggatttacggngtaacttaacgg

SEQ ID NO: 17515 - DNA, 652 bp, Homo sapiens
  misc_feature: GYAE6OF01BZT27.11.63.F08.1.454.CMB.1.raw
  modified_base (172)..(172): a, c, t, g, unknown or other
  misc_feature (172)..(172): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (490)..(490): a, c, t, g, unknown or other
  misc_feature (490)..(490): n is a, c, g, or t
  modified_base (523)..(523): a, c, t, g, unknown or other
  misc_feature (523)..(523): n is a, c, g, or t
  modified_base (639)..(639): a, c, t, g, unknown or other
  misc_feature (639)..(639): n is a, c, g, or t
tcagcgagagataccacgaccggtgctcgatttagcgatcgtataagggggagcatcacccagcaaccacatctgtcctctagagaactcccctgagagcctcccgttcctcaccagtggactggacctggaggtactcctcttcgttggtggcagcacgccaacgaggacncccacctcccgaggtcgcgtaggttggtgcgaggtcggtggggctgaggtagaagacgcgtcgggctacgaggtgacgtctcgtgacgagtctgnggatacgcgtctacgcgtctactatagngacgtacggtcgggtacgacggacgccgtcccgaggaacgaggtctggaggtgaggtacgggacgactaacctaacgtagttggacggtagaacgtaactaagtcacgtacgaagtacggtaaggtacggaacggtcgtaacgggtctaacgtcgaacgtacggaacggaaccggtacgaaccttaccgaacgtnaaccgggacttaagacccgtaccgtagtacggngtaccgagtacgacgtcggaaacgtcgtaacacgttacggacgtacggaccggacggtacgttcgaaggttcttcggagtacggacgaagtacgggtaagtcgggtaatttacggngttaacccgtacg

SEQ ID NO: 17516 - DNA, 821 bp, Homo sapiens
  misc_feature: GYAE6OF01DYO6C.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggaccgtggaggactccttcttcgttggtggcagcagccacgaggacgcccacctcccgaggtcgctagttggtgcgagtcgtggggctggaggtgaagacgccgtgggcctcgagtgaacggtctccgtgacgaacggtcttcgtaggatacgagtccgttacgaccggtacttaactatagtcgcgtacggttggggtacgaccggaccgacccgggccccgtagggaaaccggtacgggttccgtttagggacggttagggacgggtacggggtaaccgtaacgttaacccgtaaaacccgttaaggttacggttacggggtacgaaccgtaaacgtaaacgttacggtacgaaccgtaaacggtaagggtttaaacgggtttggggaaacgggtacgtaacggggttacctaacgtacgaaaccggttaccggaaccgggaacggggtaccctaaccggtacaacgtacggacgaaccgtaacctaaccggacctacggtaggtacgggtaccgtcggtaacgggtacgaacggtaccggtacgtaacgtacgttaactaccgggacgaacccggtaccggtaccgggttaccgtttaaacggtttccgttaaggtacgggtacgaacggggtaaagtaacgggtttaaacgggttaaaggggtactttacgggttaaggtaaccggtttaaacccgg

SEQ ID NO: 17517 - DNA, 718 bp, Homo sapiens
  misc_feature: GYAE6OF01D6IIV.11.63.F08.1.454.CMB.1.raw
  modified_base (225)..(225): a, c, t, g, unknown or other
  misc_feature (225)..(225): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcgttggtggcagcagccacgaggacgcccactcccgaggtgctagttggtgcagtcgtggggctggaggtgaagagccgtgggcctnagtgagtcctctgcgaggtcttcgtggatacgacgtccttaccgaccgtcttactagtatcgactacgtggggtcgaccggtaccgaccgggccccgttagggaacggtaacggggttctttagggaacggttgggtaacggtacggggaacgtacgtaccgtaaacccgttaagtacggtgggtacgactaactaacgttagacgactaacgtacggttaagttacgggacgggtacggtacggtactacgtacgtacgtacggaaccgtaagggtaccctaaccggtaccgtacgtaccgaacgtaccaaccgtaccgaccgtaacgaggtacgggtacgcggtaacggacgtacggtacggtactacgactagtaccgtaacggaaccggtaccggtaccggttaccgttaagttacgttacggtgggtaaccgaaggaaacggtaaggtaacggtaaagggttggtttaacgtaggtaacgttaaccgg

SEQ ID NO: 17518 - DNA, 820 bp, Homo sapiens
  misc_feature: GYAE6OF01DHLAB.11.63.F08.1.454.CMB.1.raw
  modified_base (733)..(733): a, c, t, g, unknown or other
  misc_feature (733)..(733): n is a, c, g, or t
tcagcgagagataccacgaccggtgctcgatttagcgatcgtataagggggagcatcacccagcaaccacatctgtcctctagagaactcccctgagagctccgttcctcaccatggactggacctggaggatcctcttctggtggcagcagccacgaggagcccactcccaggtgctagttggtgcagtcgtggggctgaggtagaagagccgtcggggcctacgagtgaaggtctccgtgacgaggtcttcgtaggatacgagtccttacgacccggtcttaactagtagtcgtacgtacggtgggtcgacggaccgaccgggtaccccgtaggaacggtaacggggtctttagggagggttaggaacgggtcggggtaacgtaactaacccgtaaaacccgttaaggttaacgggtcgggtaacggaacccgaaacgtaaacgtagttacgacgtaacgtaaggtaacgggtttaggacgggacgggtagggtactacgtaacgaggtacgaacccgggaggtaaccccgtacgtacccgtactaacgtagaacccgtaaacgccgtaaacccgtacgtaagggtaccgtaagggtacccgtagtaaggggaccccgaggtccgggttaaaccggtaacctaacgggttacctaaccggggaaacccgggtaacccgggtacccggttaaccccggggtttaacgtttaaggtttaccgggtttaacggnggaaaaaccggggtaaggaaagggtttaaaacgggggttaaagggttacggtttaggggttaaaccgttcgtttaaaaaccccgggg

SEQ ID NO: 17519 - DNA, 522 bp, Homo sapiens
  misc_feature: GYAE6OF01BVB8N.11.63.F08.1.454.CMB.1.raw
  modified_base (218)..(218): a, c, t, g, unknown or other
  misc_feature (218)..(218): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagcctggggcctnagtgaaggtctcctgcaaggcttctggatacagcttcaccggctactatatgcacgtgggtgcgacaggcccctggacgagggcttgagtggagtgggacggatcaaccctaataggtggtggcaacaaactatgacacagtaagtttgagggcagggtcatcatgaccgaggacacgtcatcagcacacgcctacagtcggacgcgtaggacgcgaggtctcgacatcgagacgacgacggccgtagtacgttacgtggtcgacgaaggagtaaggtaaggggtatttggtagtaattaacgg

SEQ ID NO: 17520 - DNA, 703 bp, Homo sapiens
  misc_feature: GYAE6OF01DCTJU.11.63.F08.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacncccactccaggtgctagttggngcagtcgtggggctggaggtagaagagccgtggggcctgagtgaacggtctcctgcaaggtcttcgnggatacagtcttcaccggntactatatactacgtgggtgacgacacggcccctggaaccaaggtcttggagtaggagtcgggacgtactaccaaacccgtaagtaaggnggtacggactaaccgaaaacgttatacgaaccgaacgtaacgggtaaagttttacgggaagggggtaccgtaaagggggtacctaacgtcccgtaagttacggaaaccccgtaacgggggaacccttaacccgggttacccaagtaccgaaacggacctaaaccgacggtaacccctagtaacgttacgggacgttccgtaaggaacggacggacgggtactacggtaaacgtcttaacgacgaaccggaccggacggtaccggttagtaacttaccggttaggacggtcgaacgggtagaaacgggttaaaggagtttacgaaggtagtacttaaacccggg

SEQ ID NO: 17521 - DNA, 828 bp, Homo sapiens
  misc_feature: GYAE6OF01AOXG1.11.63.F08.1.454.CMB.1.raw
  modified_base (283)..(283): a, c, t, g, unknown or other
  misc_feature (283)..(283): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctcagtgaaggtctcctgcaaggcttctggatacagcttcgaccggctactatatgacacgtgggtncggacacgggcccctggacgaacgggtcttaggagtggagtcgggacgactccgaaacccgtaagtacggtggtaggaccaacgtaaaaccgtagtacggaccaacgtaaggttaaagggttttcggaacgggggtaccgtaagggggttacctaacggttaccgtaacggttaacggaaccccgggtaacgggggtaaacccgtaaaccccggttacccgaaacggtttaccccgaaacggacccaaacccggtaacgtaccccccgtttaaacgaacgggttacgggaaccggtaccgttaagggaaccggaccggtaacggggtaaccccgtttacgggaaacccttaacggtttaacccggttaaccgggaaacccggttaacccgggacccggggttacccgggttttaaacggttaaaccgttttaccgggttacgggtacgggtaaacccgggtaaagggttaaacggggtaaaagggtttaaaaacgggggtacggttttaaggtaacgggttaaacgttaacgggtttaaaccccg

SEQ ID NO: 17522 - DNA, 669 bp, Homo sapiens
  misc_feature: GYAE6OF01BLFQ8.11.63.F08.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (574)..(574): a, c, t, g, unknown or other
  misc_feature (574)..(574): n is a, c, g, or t
tcagcgagagataccacgaccggtgctcgatttagcgatcgtataagggggagcatcacccagcaaccacatctgtcctctagagaatcccctgagagctccgttctcaccatggactggacctggaggatccttcttcgttggtggcagcacgccacgaggacgcccactccgaggtgctaggttggtgcgtagtcgtgggctgaggagaagagcgtgggctcgagtgaggtcnctgacgagtcttcgnggtatacgacgtcttcgaaccggtcttaacgtataacgtgaccgtaggtgggtcgaccggtacgaccggtcccgtaggaacgaagggtctagggagtgggaagttcgggaaccggtatacctaaaccgttaggtaaggttacggacggaacaacgtaaaacttcgaacgacaacggtaaggttaacgttgggaacggtaacggagggttacactacgtacggtacaccgggaaacggtaacgtaccgtaacgaagttaccgacaccgaaacgccggttaacaagtcgggattaccgactaggacggacaacggtcctaaggacngtacggtcaaccgggtcgtaaccgggtcgttaagtcgttacgcggtacgaacgtaggaagttaagggagttaaggtagtacgtaagttaaacccg

SEQ ID NO: 17523 - DNA, 579 bp, Homo sapiens
  misc_feature: GYAE6OF01D18HK.11.63.F08.1.454.CMB.1.raw
  modified_base (426)..(426): a, c, t, g, unknown or other
  misc_feature (426)..(426): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctcagtgaaggtctccgtgcaaggcttctggatacagcttcgaccggctactatatgcactgggtgcgacacggcccctgggacaaggggcttggagtggagtggggacggataccgaaccctaataggtggtggacaacaaactatcgcaacgagaaggtttggagggacgtagggtcatcatagaccgaggacacgtcagtcagcacngaccctacagtggagtcgtggacgacgaggctaggaactcgtacgtacggaccggtaacgccgggaccgttaggttaacttacggttaggcggtacggaaggtaaggaaacggtaaaggggtactttagggtacgtagttaacgttaacccgg

SEQ ID NO: 17524 - DNA, 830 bp, Homo sapiens
  misc_feature: GYAE6OF01CG6I5.11.63.F08.1.454.CMB.1.raw
tcagcgagagataccacgaccggtgctcgatttagcgatcgtataagggggcatcacccagcaaccacatctgtcctctagagaatcccctgagagctcccgttcctcaccatggactggacctggaggatcctcttcttggtggcagcagccacaggacgccccactcccaggtgcagttggtgcagtcgtgggctggaggtgaagacgcgtggggcctcgagtgaaggtctccgtgcaaggcttcgtggatacagccttcgacccggtctaactatatgcacgtgggtgcgacgcggccccgtggaaccgaagggtcgttaggaggtgggtagtcggggaacggtactacccgaaacccgttaaggtacgggttgggtacggaacctaaaccgtaaacgttagtcggtaccaacgtaagggttaaacggttttaggggaaacgggtcggtaagggggttactaaacggttaccgaacggttaccggaaacccgggtaacggggaaacccgttacccggtaacccgtaagtacccggaaccgtaccgaaacccgtacggtaaccccgttaaccgtaacggtacgggtaaccggttaccgtacgggtaaccggaccggtaacgggtcccgttaaacgggaaccttaaccggttaccggtaccgggaaaaccccgtacccggggtaaccgggttacccgggtttaacgggtttaacgtttaaccggtttcggggtaacgggaccggtaaaggggtaacggttaaaaggggttaaaaacgggggttcgtttaagggttaacggttaacggtttaaacggttaaaacccccgg

SEQ ID NO: 17525 - DNA, 716 bp, Homo sapiens
  misc_feature: GYAE6OF01D0QU1.11.63.F08.1.454.CMB.1.raw
  modified_base (522)..(522): a, c, t, g, unknown or other
  misc_feature (522)..(522): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggactcctcttcttggtggcagcagccacaggacgcccacctcccaggtgctaggttggtgcagtcgtgggctggaggtgaagacgccgtcggggccttcgagtggaacggtcctccgtgacgaaggtcttcgtggatacgagtccttcgaccggtactaactattacgtcgcgtacgtggggtcgaccgacgaccgggccccgtagggaaccgaaggggtccttaggacggttgggaaggtggggacggtactacctaaaacccttaagtacggtggtacgacaaactaaacgtatacgactaacgaaggtaagtttaggaagggacgaagggtcatacgacgtacgaccgagggaccacgtaccactacgacgacaaccgtacgaccctaanacggtagggactacggtaagacggacgtaacgggtacgtaagtacgtaacgtccgtaacggaaccgtaacggtacccggtaaccggttaggtttaaacctttaccggttagggtaccggtaaaccgggtaagggtaaacggttaaacgggtttaaaaggggttagtttacgggttacggtaaagttaaaccggg

SEQ ID NO: 17526 - DNA, 744 bp, Homo sapiens
  misc_feature: GYAE6OF01DUCRY.11.63.F08.1.454.CMB.1.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (712)..(712): a, c, t, g, unknown or other
  misc_feature (712)..(712): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttctggtggcagcagccacaggacgcccactcccaggtgcagttggtgcagtcgtggggctggaggtgaagagccgtggggcctgagtgaaggtctcctgacaaggtcttcgnggatacgagtccttcgacccggtctactatatcgctacgtgggtnacggacgacggtcccgtaggacgaacgggtcttggacggtaggagtaggggacggtactaccgtaaccgtaagtacggtagggtacggaaccaacgtaaacgtagtcgaccgtaacgaggttaaaggtttggaacggggtacgaacggggttctaacgtcgtaacgttaccgaacccggtaacggggaaccctaccgtaccgaagtcccgaacgtacgtaaccgacggtaccctaacgtaggttaacggacgttcgaaccggtacggaccggtaacggtccgtacggtaacgttacgtacggtaacccggaaccggaaccggtaccccgggttacccgttaacgggtttaacgttaacccggttaggtcggggtaaacccggaagtaagggggtaaaaccgggttaaaagggggtttntttaaacggggtagttaaacggttaaacccgg

SEQ ID NO: 17527 - DNA, 782 bp, Homo sapiens
  misc_feature: GYAE6OF01DE6BR.11.63.F08.1.454.CMB.1.raw
  modified_base (244)..(244): a, c, t, g, unknown or other
  misc_feature (244)..(244): n is a, c, g, or t
  modified_base (427)..(427): a, c, t, g, unknown or other
  misc_feature (427)..(427): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgcagttggtgcagtcgtggggctgaggtgaagagccgtggggcctcgagtgagtctctgcaggcttcgnggatacgagtccttacgacccggtcttaactatatggcgacgtggggtggcggacgacgggtccctgggaaccgaagggtcttggagggtggagtagggacgtaatccgaaaccgttaagtagtcgggtagaccaacgtaaactaggtacgacgtaacgtaggttaaaggtttcgggaagggnggtaacgggttcaagtacgacgtacggtaaccggaacggggtaccctaccggtaccgtaaacgtccgaaccgtacgtaaaccccgacggtaacccgtttaccgaacggttacgggtacgtaaccggtttaacgggaaccggggttaaccggaaccgggggtacccttacggtaaaccgttaaccgtaccggttacccgggaaaccgggtacccgggtaaaacccggggtcccgggtttaacggtttaacgttaccgggttagggttaaccgggaccggtaaagggtaaacggggttaaacggggttaaaacggggggtttagtttaacgggtaaggtttaacggttaaacccggg

SEQ ID NO: 17528 - DNA, 642 bp, Homo sapiens
  misc_feature: GYAE6OF01DNBOT.11.63.F08.1.454.CMB.1.raw
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (627)..(627): a, c, t, g, unknown or other
  misc_feature (627)..(627): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgcgaggttggtgcagtcgtggggctggaggtgaagaacgccgtggggcctcgagtggaaggtcctcctgcaaggtcttcgnggtaatacgagtcctcgacccggcttaacttatatcgactacgtgggtcgacgacgacggccccgtggacgaagggtcttaggngtggaggtgggacgataccaaccgtaagtgtaggcgacaacgtaaacngtacgacaacgtaggtaaggtttcggaagggtacgagggtacagtacgacgtacgaccggtaacgggactaccgtacctagaccgacgtaccgacgaccgtacctaacgacgtagggacgtgtaacggagacgtagggacgagtactacgttcggacgaaccggtacggaccggtcgtacgttacttaggtagtacggaacggtaaggaagttaacgggtaaaagggtgtttaacgggngtaaacgttaaccgg

SEQ ID NO: 17529 - DNA, 805 bp, Homo sapiens
  misc_feature: GYAE6OF01BYL3W.11.63.F08.1.454.CMB.1.raw
tcagcgagagataccacgaccggtgctcgatttagcgatcgtataagggggagcatcacccagcaaccacatctgtcctctagagaatcccctgagagcctccgttcctcaccatggactggacctggaggatccttctttcgttgggtggcagcacgccacgaggacgcccacctcccgaggtgcgtaggttggtcgcgtaggtcgtggggctggaggtaggaaggaacggtccggtcggggtcctcgagttacggaacggttcctccgttaggaccgtaaggttccttaccgtagggtaacttaacgacgttaccgttacccgacccgggtacttaaccgtaattacgtcggaccgtaccggtgggggtacgaccgaccggtaccggccccggtaaggaaccggtaacggggttacggtttaggaacgggttagggaacggttacgggggtaaaccggtaacgtaacccgtaaaacccggtttaaaggttacgggtacgggttacgggaacaaaccgttaaacgtacgtacgaacgtaacgtaaggttaaggttacgggaacgggtacgagggtacgtacgtacgaaggtacggaaccggagggtaaccgaaccgtacaacgtacgaccgaaccacgaacgaccttaacggacgtacggaacgtacgtaggaccggtacggacgtacggtaccgtataccggtacgaccgaccggacgtaccggtacgttaggttaactcggttaggcggtaacggtaaggaggttaaaggtaagggttattacggtaggttaacgttaaccg

SEQ ID NO: 17530 - DNA, 736 bp, Homo sapiens
  misc_feature: GYAE6OF01B0TGC.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggagcccactcccgaggtgcagttggtgcagtcgtggggctggaggtagaagaacggtccgtcggggcctcgaggtgaaggttcctccgtgcgaaggtcttcgtggactacgcgtcttcgaccggtctacttatatcgacgtacgtggggtcgaccggaccgaccgggtaccccgtacgggaacgtaacgggtccgttagggacggttggacgggtaggggaaccggtaacgtaccgtaaaacccgtaaggttacggtagggtcgaaccgtaactaaacgtgtacgtactaacggtagttaaggttggaggggtacagggtacagttacgagttcggaacggacggacccgtacgtccgtacgtcgaacgaccaccgacgttaccgagtaggtacgggacacggttacggacggaccgacgttccgtagtacgtaacttcgggtaacccgaaccgggtccgaacggggttcccgtttaagttaccggttaggtacggttcgggaaacggtaaacggttaaggggtaaaaccgggttaaagggttagtttaaagggttagtaacgttttaaaccccggg

SEQ ID NO: 17531 - DNA, 772 bp, Homo sapiens
  misc_feature: GYAE6OF01BJR51.11.63.F08.1.454.CMB.1.raw
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (583)..(583): a, c, t, g, unknown or other
  misc_feature (583)..(583): n is a, c, g, or t
tcagcgagagataccacgaccggtgctcgatttagcgatcgtataagggggagcatcacccagcaaccacatctgtcctctagagaatcccctgagagctccgttcctcaccatggactggacctgggaggatcccttctttcgttgggtggcaggccagcccacgaggacgcccacctccccgagggtcgcgaggttggtgcgaggtcggtggggcttggaacggtagaaggaacgtcggtcggggtccgtacgtgtaggtaacggtctccgtgacgagtctcgtaggatacncggtctccgaccgtacgtactatntagcgtcgtgggtgcgaccgacggcccgtacggacgacggtagttcggaggtaggtacggtcgggacgtaacgtaccgtaaacccgtaggtacggtaggtacgacgaacgtaaactacgtccgaaccgtaaggtaaggtaacggtttaacgggacggggttaccggagggtctaacggtacgtacggtaaccgaaccgggaaacggacggtaaccgaccgtaacgtaacctcggaaccgaaccgtccgtaacccgtagtaacggnggacccgttagggccgtacggggaaccgaggggtacctacgggaactccggttaaccggtccgggaaacgttaccccgggacggttcccggttaaggtttacggtaaccggtttgggaacccgggtaaaggtacggaaacgggtaaagggttacggtaaagggtttggtaacgtaaggtttaaaccccg

SEQ ID NO: 17532 - DNA, 763 bp, Homo sapiens
  misc_feature: GYAE6OF01B1U05.11.63.F08.1.454.CMB.1.raw
  modified_base (163)..(163): a, c, t, g, unknown or other
  misc_feature (163)..(163): n is a, c, g, or t
  modified_base (279)..(279): a, c, t, g, unknown or other
  misc_feature (279)..(279): n is a, c, g, or t
tcagcgagagataccacgaccggtgctcgatttagcgatcgtataagggggcatcacccagcaaccacatctgtcctctagagaatcccctgagagctcccgttcctcaccatggactggacctggagatcctcttcgttggtggcagcagccacgagggacncccactcccaggtgctaggttggtgcaggtcgtggggctggaggtagaagagcgtggggcctgagtggaacggtctcgtgacgtaggtcttcgtggatacgagtctaccgaccgtntaaccttagtacgtgaccgtaggttcgggtcgaccggtaacggccgggtaccccgtaggggaaaccggtaacgggttccgtttaggggacgggtttagggagggtacggggtaaccgtaacgtaaccggtaaaaccgttaaggtacgggtttaggaccgaacgtaaaactaaacgtacggttacgaacgtaaacggaagggtttaacgggtttacgggacgggtaggtaacgggttactaacgttagtaacggtacggacccgggtaagggtaaccctaccggtactaacgtacgacggtaacctaacgacgtaacccgtagaggtcggtaagtccggtaaggacgacggtacggtacgttacggaactgtaccgaacggtaaccggaccgaccgtaccgttagttacggttacgttacgagggtaacgacggttaaaggaacgggttaaaggtaacgggttatagttaggtaactaaaccggg

SEQ ID NO: 17533 - DNA, 695 bp, Homo sapiens
  misc_feature: GYAE6OF01CZFC5.11.63.F08.1.454.CMB.1.raw
  modified_base (261)..(261): a, c, t, g, unknown or other
  misc_feature (261)..(261): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacgcccactcccaggtgcagttggtgcagtcgtggggctggagggtgaagaacgccgtggggccctcgagtggaacggttctccgtgacgaaggtcttcgnggtaacttacgaggtccttaccgaccggtcttaactatacgtgacctacggtggggtcgcggaccgacgggccccgtaggaacgaaggggtccttaggacggttagggagttacggggacggtaacgtaacccgtaaacctaagtaggtcggtacggaaccaaacgtaaactagtacgacgaacgtaggtaagtttagggaggtacggtacgggtactaacgtacaaggtaccgaacgaacgggtacctaaccggtacaacgtaccgacaccgaaccacgtacccgtagtacgtagggactcggtacgacggacgacggtccagtactacgtacgtacggaaccgacgaccggttacgttagtacgttacgttgggacgtacggaagtaacgggtaacggtaaagggtagtttaggtaaggtgtttaaacccgg

SEQ ID NO: 17534 - DNA, 777 bp, Homo sapiens
  misc_feature: GYAE6OF01BDG8R.11.63.F08.1.454.CMB.1.raw
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
tcagcgagagataccacgaccggtgctcgatttagcgatcgtataagggggcatcacccagcaaccacatctgtcctctagagaatcccctgagagccccgttcctcaccactggctggacctggaggatcctccttcttggtggcagcacgccacaggacgccacctcccgaggtgctagttggtgcgagtcgtggggcgtaggaggtagaaggaagccgtgggcctcgagtgaacggtctcctgacgaggcttcgtgacgtcacgcttcgaccgtactactatangctacgtcggtcgtacgaccgacggcccggtcggacgtaacgggtctggtacgtgggtaacggngggtaacgtacgtacctaaacccgtaagtacgtagggtcggaacgtaaaccgtaaacgtacgtacgaacgtaacggtaaggtaacggttttagggaacgggtcggtaaacgggtctaacgttaccgaagttccggaaacccgaggggtaaccccgtaaccgttaacccgaacgttacgaaccgtaccgtaacctacgtaccccgtaacgtacggttgggaaaccgtctacgggaacggtcggtaaccgtggaacgtaccggtagtttaaccgaccggttaacccggaaccggttcccgggttccggttaaacgtttcccggttagttaacggggtggaaccgggttaaaggaagggtaaacgggtaaaagggggtttcgtttaaacgttcgggttaaacttaaaccgggttaaccctttaaccggg

SEQ ID NO: 17535 - DNA, 672 bp, Homo sapiens
  misc_feature: GYAE6OF01CM8CZ.11.63.F08.1.454.CMB.1.raw
  modified_base (133)..(133): a, c, t, g, unknown or other
  misc_feature (133)..(133): n is a, c, g, or t
  modified_base (157)..(157): a, c, t, g, unknown or other
  misc_feature (157)..(157): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagcgagagataccacgaccggtgctcgatttagcgatcgtataagggggcatcacccagcaaccacatctgtcctctagagaatcccctgagagctccgttcctcaccatggactggacctggagatcctnttctggtgcagcagccacaggacncccactcccaggtcgactagttggtcgctaggtctcggggcttggaggtgaagacgccgtggggcctcaaggtgtaacggttccncgtgacgaggtcttcgtaggatacngtccttccgaccggtntaacgttatacgtcgcgtacggttcgggtacgaccgtacgaccggtccccgtagggaacggaacgggtcttagggacggttaggacggtacgggggaaccgtagaaccccgtaaacccggttaagttaaggtcgggtacggaacctaacggtaaaacctagtacgaacgaccgtaaggttaggtttacgggacggtaggaacggtacactacgtagtaacggacgtacgggacctaacggtcacgtacacganacgactcaatggtagngactgaacngacggcctagactacgtgtacgacgtacgccggtattagtaccgtgtggttacggaacggtaagaaagggtacggtaaggtaacggtttcaaggttacgttacgtaacccg

SEQ ID NO: 17536 - DNA, 688 bp, Homo sapiens
  misc_feature: GYAE6OF01A975L.11.63.F08.1.454.CMB.1.raw
tcagcgagagataccacgaccggtgctcgatttagcgatcgtataagggggagcatcacccagcaaccacatctgtcctctagagaatcccctgagagcctccgttcctcaccatggactggacctggaggatcctcttcttggtggcagcagccacgaggacgcccactcccaggtgcaggttggtgcagtcgtggggctgaggtgaagaacgccgtgggcctacgagtagaggtcctcctagctaaggcttcgtaggactacgacgtccttaccgaccggtcttaactattagtcgccgtacggtgggtcgaccgacggtaccggtaccccgtaggaacgtaagggtcgttaggacggtggacgtacgggtaacggactacccgaaaccggttagtacggtacggtacggacaaaccgtaagtagtcgacgaacgtaggtaacggttggacgggactacgggtactacgtacgtacgacgtaaccggacggtaccaccggtaccgaatacccgataccgaacgaccgtaccgtaaccgaggttacgcgtacgtacggacgtaccggtacgggtaccaaggttactaccggtacgtacgaccggtaccgacgggtaccgtttagtacgttcgaggtcgagggtaacaaggttaacggtaaggttagttcggaacgttaggtaacccg

SEQ ID NO: 17537 - DNA, 748 bp, Homo sapiens
  misc_feature: GYAE6OF01CWMOD.11.63.F08.1.454.CMB.1.raw
  modified_base (164)..(164): a, c, t, g, unknown or other
  misc_feature (164)..(164): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggactcctcttcgttggtggcagcagccacaggacncccactcccgaggtgctaggttggtgctagtcgtgggctggaggtgaagagccgtgggcctgagtagaacggtctccgtgacgaggtccttgaggaattacaacgtcttaccggacccggtacttaacctataacgtcgtaccgtacgttcgggggtacaccggaacggtaccgggaccccttaggggaaccgaacggggttcgtagggtaggtagggtacgtaggggaccgtacgttaccaaacccgttaagtcggtaggtacgactaaacgtaaacgtatacgggaacctaagagggttaaacggtttggaaacggggtactaacggggttactaaacgtacgtcgtaacgggtaaccggtaacgggacccgttaaccggtaactaacgttaccgagaacccgacgtaacggtaccccgtaagtaccggtaggaacgtcgaaggttacgacggtacgtacgacgtaacgacgttacgaccgaacggtacgtacccggtacgttacgtaacgtttacggtggttacggaaccggtaaggtacggtaaaggttaaaggggttcttaggtcgtaagttaacccgg

SEQ ID NO: 17538 - DNA, 623 bp, Homo sapiens
  misc_feature: GYAE6OF01E0BA3.11.63.F08.1.454.CMB.1.raw
  modified_base (596)..(596): a, c, t, g, unknown or other
  misc_feature (596)..(596): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgcaggttggtgcagtcgtggggctggaggtgaagagccgtggggcctcagtgaaggtctctgacaggtcttcgtggatactagtttccaccggtactactatatcgctacggtgggtcgcgacgaccggcccctagggaaccgagggtcttaggaggtggagtacgggacgtactaccaaccgtaagtaggtcggacgtacaataaactgtcgacagtaaggtaaggttaggaggtcgtagggtacagtcaagtacgaacgagggaccctacgtaccatacacgactacacgtacctagagtcggatcgtagacgacgacgacgtacgaaccgtagtacgacggaaccgacggtaccggtaccgttaggtttacgtacgtagggtacggaggtaacggtaaagggtaacgttaacggggtnttaaggtcgtaaacgtacggttaaccg

SEQ ID NO: 17539 - DNA, 720 bp, Homo sapiens
  misc_feature: GYAE6OF01ANIZI.11.63.F08.1.454.CMB.1.raw
  modified_base (704)..(704): a, c, t, g, unknown or other
  misc_feature (704)..(704): n is a, c, g, or t
tcagcgagagataccacgaccggtgctcgatttagcgatcgtataagggggagcatcacccagcaaccacatctgtcctctagagaatcccctgagagctccgttcctcaccatggactggacctggagatcctcttcttggtggcagcagccacaggagcccactcccaggtgcagttggtgctagtcgtggggctggaggtggaagaacggccgtggggccctgaggtgaaggtcctcctagcgaaggtcttcgtaggactaccgagtcctttccgacccggtctaacctataacgtcgtccgaacggttcggggtcgaccggaccgaccgggtccccgtagggaacgaacgggttctttaggacggtagggagtggggtaaccgtactaccgtaacccgtaagtcggtcggtacggtacccaagttaaaacctacgacggacgtaacgtaacgggtaaaggtttcggggaaccggtacggtaaggggttaccaacgtttacgaacgttcggaaccccggtaacggggtaaccctaccgtaacccgtataccgacgacctaacgcgtaaccctagtacgtggaacgtcgttacgggacgtaccgaggtacccgagtacaccgtacgtgaaccgacgtacggaccgttagttacgtcgttaggccgtaacgggtagaaacggtagggtaaagggttatacggngttaacgttaaaccgg

SEQ ID NO: 17540 - DNA, 706 bp, Homo sapiens
  misc_feature: GYAE6OF01CUCWU.11.63.F08.1.454.CMB.1.raw
  modified_base (658)..(658): a, c, t, g, unknown or other
  misc_feature (658)..(658): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccgaggtgcagttggtgcagtcgtggggctggaggtgaagaagccgtggggcctcgaggtcggaaggtcctccgtagaccgtaaggtccttacggtagtaacgtaccgtacggtccgttaccgtacccggtaccttaacgttacttacgtcgtaaccggtcggtcggggtcgacggaccggtacccggtccggtaacggaacggtaacggttccgtagggtggtacgggaggtaacggggacgtaacgtaacccgtaaaccgttaggttacggtcggacgacaaaccgtaagtcgtagactaagagttaaggtcggtaggaccggtagtactacgtagtacgtacggaacggacggaacctacgtactacgtacgaccgtacgaccgacgtacctagtacgtagacgtacgtaggacgacggaacgtgtacccccgtgtacgtccgtaccggaacgtaccgggacgttacgtacgtacgttcgtacggnggtacgtaggtaagtaacggggtagtagtacggtaatacggttaaccg

SEQ ID NO: 17541 - DNA, 817 bp, Homo sapiens
  misc_feature: GYAE6OF01CBJVA.11.63.F08.1.454.CMB.1.raw
  modified_base (163)..(163): a, c, t, g, unknown or other
  misc_feature (163)..(163): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacncccactcccaggtgctaggttggtgcagtcgtggggctggaggtgaagaacgcgtggggcctcgaggtgaacggtcctccgtagcgaaggtcttcgtaggatacgagtccttaccgaccggcttactatagtgacctacggttgggtcgaccggacgaccgggtccccgtagggaacgtaacggggtcgttagggacgggtagggtacgggtacgggggtaaccggtaactaacccgtaaaacccgtttaaggttacgggttacggggtaacgggtaacccaaaaccgtaaaacgttaggtaccggaaccgtaacggtaaaggtttaacgggtttaggaccgggggtacggtaacgggtactaacgtaccgaacgttaccgggaaccgtaacgggggtaccctaacccgtacccgtaaagacccggaactacccgaaccgtaaccgggtaacccctaacgtacggttaggggaaccgtcggtacggacggaccggtacggtacgttaccgaacggttactacggtaccgggaaaccctaccggggtaacccggttcggttacgttaacccgtttaggttacgggttacggaccgtaaaggggaacggttaaagggttaaaggggtactttagggtaacgtaaggttaaacccgg

SEQ ID NO: 17542 - DNA, 612 bp, Homo sapiens
  misc_feature: GYAE6OF01CETHQ.11.63.F08.1.454.CMB.1.raw
  modified_base (482)..(482): a, c, t, g, unknown or other
  misc_feature (482)..(482): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtcgtgggctggaggtgaagagccgtggggcctcagtgaaggtctcctgcaaggcttcgtggatacagcttacgaacggctactatatgctagtgggtcgcgacgacggccccgtaggaccgaagggtcttggaggtggagtcggggacgataccgaaccgtaagtggtggtacgacaacgtaaactagtacgactaacgaacggttaagtttgggaacgggtcgtagggtactagtacgatacggaccgagggacctacgtccaacgtcaacgccaacacgacctacgagtaggacncgtaggacgacggacgcgtagacctagtccgtacggaccgacgaccggtccgtagttaacgttcgtgtacggaggtaacggtaagtaaagggtaagggtagtttaggaggttaacgtaacgttaacccgg

SEQ ID NO: 17543 - DNA, 688 bp, Homo sapiens
  misc_feature: GYAE6OF01CGOD7.11.63.F08.1.454.CMB.1.raw
  modified_base (195)..(195): a, c, t, g, unknown or other
  misc_feature (195)..(195): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (678)..(679): a, c, t, g, unknown or other
  misc_feature (678)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
tcagcgagagataccacgaccggtgctcgatttagcgatcgtataagggggcatcacccagcaaccacatctgtcctctagagaatccccctgagagctccgttcctcaccatggactggacctggaggatcctcttcttggtggcagcagccacgaggacgcccactcccaggtgcgaggttggtgcaggtcgnggggctggaggtgaagacgccgtggggcctgagtgaggtcctctgcaggtcttctggattacgacgtccttaccgacccggtactacgttaatatcggacgtaccggttggggtcgccgaacgtaccgggcccccgttaggaaccggtaagggtccgtttagggagggtcgggaaggtacgggggtacgtaacttaccgaaaacccttaagtacgggttacgggtacgaacctaaaccgtaaactgtaccggaacaacgtaaggttaaggttagggacggtacgtacgggttacaagtacgtaacggtccggaacgaacgggacccgtaacgtacccgaacgttccgaacgaccctaaacggacccgaacccgttacgaacggttaccgggtaacgccggttagggaccgggtccgggacggtacgggaaccgggtaaccggacgttaaccgaggtacgcgactgagngcngancgngngcgnngncngngtc

SEQ ID NO: 17544 - DNA, 714 bp, Homo sapiens
  misc_feature: GYAE6OF01DHJBE.11.63.F08.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
  modified_base (436)..(436): a, c, t, g, unknown or other
  misc_feature (436)..(436): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggactccttcttctggtggcagcagccacgagggacgccctacctcccgaggtcgcgtagttggtgcgagtcgtggggctggaggtacgaagacgccgtggggcctcgaggtgaacgtctccgngcgaggtcttgngtactacagtctcaccgtctactatgcncncgtgggcgaccgacgaccggtccctaggaacgaagggtcttggaggtggacgtaggggctaacgtactaacgtagtggtgggtacgacaaactaacgtncgacctaagacggtttaggttagggacggtacgaccgggttanacgtaccgagtaacggaccggaacgggtaacctaccgggtaacacgtacggacgaccgtaaccggtaaccgtaccgtacgttacgggacggtacgacggttagaccggtacggagggtccgttaacggacctaacggtaccggtaaccggaacccggtaacccgggccggttaccggttacggtttaacccgtttagggttccgggttagggaaccgggtaaggtaagggtaaaggggttaaaaggggttcgttaaggttacgtaacggttaaaccgg

SEQ ID NO: 17545 - DNA, 863 bp, Homo sapiens
  misc_feature: GYAE6OF01DKCP9.11.63.F08.1.454.CMB.1.raw
  modified_base (835)..(835): a, c, t, g, unknown or other
  misc_feature (835)..(835): n is a, c, g, or t
tcagcgagagataccacgaccggtgctcgatttagcgatcgtataagggggcatcacccagcaaccacatctgtcctctagagaaatcccctgagagctccgttcctcaccatggactggacctggaggatcccttcttcgttggtggcagcagccaacgaggacgcccactcccgaggtgctaggtttggtgcgaggtcgtgggggtctaggaggggtagaaacggaaggtcccggtcgggggcccttacgaggtaggtaacggtcctccgtggaccgtaacggtctttcggtaggaacttaaccgacgttccttaaccggaacccggtacctttaacttaatacgtcggactaaccgggttgggtaccgacgaccggtaccggccccggtaggaacggtaacggggttcgttagggaggttacgggaacggttacgggggaaccgtaacttaaaccccggaaacccgtttaaaaggtttgggggttaccgggtaacgggaacctaaaaaaccggttaaaacttacgtaccggaaacgtaaaccggttaaaaggtttaacggggggttttaagggaaacccgggggtagggttaaacggggtactaaacgttaaccgtaaacggtaccgggaaaccggtaacgggaaccgtaacccgtacgaacgtaccaccgacgaactaacccggtaaccgtagtaggtaggtacgtaagtcggaaacgtcgtaacggtacgtacggaaccttacgtacgtcgaacgggtaccgaccgggttcgttaggttaacgttacggagtacggaacggtaacgggtaaggtaaaggttaaacgggtnttaaggttacgaggttaaccctaaccgg

SEQ ID NO: 17546 - DNA, 812 bp, Homo sapiens
  misc_feature: GYAE6OF01DFXLR.11.63.F08.1.454.CMB.1.raw
tcagcgagagataccacgaccggtgctcgatttagcgatcgtataagggggagcatcacccagcaaccacatctgtcctctagagaactcccctgagagcctccgttcctcaccatggactcggaccgtggaggatcctcttcttggtggcagcacgccaacgacggacgcccacctcccgaggtcgacgtaggttggtgcgtagttcgttgggcgtggtagggtagaaaggaacggccggtcggggcctacgagtaggtacggtcctaccgtcgacgaacggtcttcgtaggtaactacgacgtccttaccggaccggtaccttaacgtatacgtcggttacggtcgggtaccggcggtaaccggaccgggtacccgtagggaaaccggtacggggtccgttaggggaacgggtacggggtaaggtacggggaacgtaccgtaaaccgtaaacccgttaagtagggtcgggtacgaacctaaacgtaaacgtagtacgaaccgaaggtaaacggttaagggttacgggagggtacggtaacggtactacgtaacgtacggtacgaaccggtaacgggtaaccctaccggtacctaacgtaacgaacgtaccgaacgtaccgtaaccgtacgtacggtcggtacgtacggaggaacgtacggacggtacgtacgacgttacgtaccgtacggaccgtaccggtcggttacgttacgttacgttacggtaggtacgggtaaccgtaagggtaaacgggttaagggtaacggtttaagggtacgttaacggtaaccgtttaacggttaaaccgg

SEQ ID NO: 17547 - DNA, 740 bp, Homo sapiens
  misc_feature: GYAE6OF01DHB64.11.63.F08.1.454.CMB.1.raw
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacgaggacgccccactccccaggtnctagttggtgctagtcgtggggctggaggtagaagaagccgtggggcctcgaggtagaaggtcctctgacaaggtctttgnggatacacgtcttccgaccggtctactatgtnctacgtgggtcgccgacgaccggtccccgtaggaaccgaagggtcgttaggacgggtggacgtggggaacgtactaccgtaaccgtaagtcgggttaggacggaacctaaacgtaaacttacgtacggaaccaacggtaaggttaacggttttagggacggggtaccgtaaggggttctacgttaccgaacgttacgggaaacccgaacgggtaaacccgtaccgtaaccgtaacgaccgaacgaccgtaccgaacggtaccctaaagtacggtacgggacgtaccgtagggaccgtaggaccggttcgtacgaaccgtgttaaccgacgaaccggtaccggtaccggtaccggtttagtaaccgtttcggtggtaacggtaccggaacggtaagtaaaacgggggttaacggttaagttcgggtaagtaacgttaaccggttaacccgg

SEQ ID NO: 17548 - DNA, 568 bp, Homo sapiens
  misc_feature: GYAE6OF01D2H01.11.63.F08.1.454.CMB.1.raw
  modified_base (441)..(441): a, c, t, g, unknown or other
  misc_feature (441)..(441): n is a, c, g, or t
  modified_base (546)..(546): a, c, t, g, unknown or other
  misc_feature (546)..(546): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagcctggggcctcagtgaaggtctccgtgcaaggcttcgtggatacagcttcaccggctactatatgcacgtgggtgcgacgacggccccgtaggaccgaagggcttggaggtggagtggggacgatccgaacctaagtaggtggtcggacaacaaactatcgacacagtagtttggaagggtcagggtcagtcagtacgaccgagggaccacgtacatcacgacacgactaccanagtaggagacgtagacgacgaggtctacgactactcgtacgacgtacgccggtacgttacgttaacgttctaggtcggacgtaaggaagtaacggttaaaagggntttaggtagtaagttaaaccgg

SEQ ID NO: 17549 - DNA, 661 bp, Homo sapiens
  misc_feature: GYAE6OF01EO2FX.11.63.F08.1.454.CMB.1.raw
  modified_base (458)..(458): a, c, t, g, unknown or other
  misc_feature (458)..(458): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacgcccactcccaggtgcagttggtgcagtctggggctgaggtgaagagccgtggggcctgagtgacggtcctcctgcgaggtcttcgtggatacgagtccttccgaccggactactatagtgacgacgtgggtgccgacgcggccccgtaggacgagggtcgtggagtggagtgggacgtaatccaacctagtagtggtgacctaacaagtagtcgactaacgaggtagtttggagggtcgtagggtcatacgtagacggacgacggactacgtcatcacgtccacgccgactacgngtggacgctaggagtacgcgggtaccgtagaaccgacgtacggtaccggaaaccggtacccgggtaaaccgggttccgggtttaaccttaacgggtttacgttacgggtacgggttaaccgggtaaagggtaaacgggtttaaaacggggttaaacgggggtttagtttaacggggttaacgtaaacggttttaaaccccggg

SEQ ID NO: 17550 - DNA, 910 bp, Homo sapiens
  misc_feature: GYAE6OF01BLPEV.11.63.F08.1.454.CMB.1.raw
  modified_base (745)..(745): a, c, t, g, unknown or other
  misc_feature (745)..(745): n is a, c, g, or t
tcagcgagagataccacgaccggtgctcgatttagcgatcgtataagggggagcatcacccagcaaccacatctgtcctctagagaatcccctgagagcctccgttcctcaccatggactggacctggaggactccttcttcgttgggtggctaggcagccacgacggacgcccactcccgaggtcgacgtaggttggtgcgtaggtcgtggggctggagggttagaacggaacggtccggtcggggcctacggaggtacggaacggttcctccgtagtacgaagggttccttcgtaggtaactacgtacgtccgttaccgaccggtacttacgtaagttaacgtcggacctacgggtggggttacgaccggtaccggtaccgggtccccggttaagggaacccggtaaggggttcccttaggggtaacggttagggtaccggggttaacggggtaaccgtaacgttaacccggtaaacccgttaaggggttacgggtagggtaaccggtaaccaaacgttaacgttagaccggtaacaaccgggtaaaggttaacgggttacgggaaccgggtacgggttaaccgggtactaacggttacggaacgggttaccgggaacccgggtaaccgggtaaccgttaacccgtaaccggttaaccgtcgggtaaccaccgtaaaccggttaccggtaaaccgttaacggcgggttaacggggtaaccctacgggtacgtacccgggtaanaccgggtaaccgtacggacgttaccgttaccgggccggaaaccgggccggttaacccggtccgggtttaagtaaccgtttaggaccggggtagaacccgggttagggaaagggtttaaaccggtaacggggttagtttacggtaacgaaacggttttaacccggg

SEQ ID NO: 17551 - DNA, 489 bp, Homo sapiens
  misc_feature: GYAE6OF02FXMEQ.11.63.F08.1.454.CMB.1.raw
  modified_base (280)..(280): a, c, t, g, unknown or other
  misc_feature (280)..(280): n is a, c, g, or t
  modified_base (411)..(411): a, c, t, g, unknown or other
  misc_feature (411)..(411): n is a, c, g, or t
  modified_base (477)..(477): a, c, t, g, unknown or other
  misc_feature (477)..(477): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtncgacaggcccctggacaagggcttgagtggatgggacggatcaaccctaatagtggtggcacaaactatgcacagaagtttgagggcagggtcatcatgaccagggacacgtccatcagcacagcctacgntggagctgagcgaggctagacatctgacgacacggcgtagtactactgtgcgagagagtaaagggnttggtagatacg

SEQ ID NO: 17552 - DNA, 483 bp, Homo sapiens
  misc_feature: GYAE6OF02I5VIS.11.63.F08.1.454.CMB.1.raw
  modified_base (353)..(353): a, c, t, g, unknown or other
  misc_feature (353)..(353): n is a, c, g, or t
  modified_base (472)..(472): a, c, t, g, unknown or other
  misc_feature (472)..(472): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcanagaagtttgaggcagggtcatcatgacagggacacgtcatcagcacagcctacagtggagctgagcgaggctgacatctagacgacgacgcgtgtattctgtgcgagacgagtaagggntaggtgatacg

SEQ ID NO: 17553 - DNA, 599 bp, Homo sapiens
  misc_feature: GYAE6OF02J1QMQ.11.63.F08.1.454.CMB.1.raw
  modified_base (388)..(388): a, c, t, g, unknown or other
  misc_feature (388)..(388): n is a, c, g, or t
tcagcgagagataccacgaccggtgctcgatttagcgatcgtataagggggaggcatcacccagcaacccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtggtgcgacacggcccctggaccgaagggctttggagtggatgggacggatcaaacctaataggtggtggcaacaaactatgcacagtaagtttggagggcagggtcattnagtgaccgagggacacggtccatccagaccacacgaccctaccgaagtcggacgcgttacgacggtaccgagggtcctacgacctacgtacgtacgaaccggaacccgtaccgggtaccggtttacgttaacgtttacttacgggttggaccggtaaggaacggtaaacggttaaagggggttagtttacgggtagtaaggtttaaaccgg

SEQ ID NO: 17554 - DNA, 526 bp, Homo sapiens
  misc_feature: GYAE6OF02IMG07.11.63.F08.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
tcagcgagagataccacgaccggtgctcgatttagcgatcgtataagggggagcgtatcacccagctaaccacatctgtcctctagagaatcccctgagagctccggttcctcaccatggactgggacctggaggatcctcttcttggtggcagcagccacaggtagcccactcccaggtgcagttggtgcagtctgggctgngtgaagagctgggcctcagtgaaggtctcctgacaaggcttgtggatacaggcttcaccggtctacctatatgcactgggtgcgaacacggcccctggacaagggcttgagtggatgggacggatacaacccgtaatacgtggtggcacaaactatgacacagtaagtttgaggcaggtcgatcatgacagggacacgtcatcagcacagcctaanagtcgganctaggagcgagtcagaccacgtccagaccgaccgacggtccgttggtacttaccgtgtacgcgaagacggaacggtaaagggctttaggagataaccgg

SEQ ID NO: 17555 - DNA, 490 bp, Homo sapiens
  misc_feature: GYAE6OF02GML87.11.63.F08.1.454.CMB.1.raw
  modified_base (374)..(374): a, c, t, g, unknown or other
  misc_feature (374)..(374): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcgaaggcttctggatacagcttcaccggctactatatgcactgggtgcgacaggcccctggacaagggcttgagtggatgggacggatcaaccctaatagtggtggcacaaactatgcacagaagtttgagggcagggtnatcatgacagggacacgtccatcagcacagcctacatggagctgagcaggctgacagtctgaccgagccggcgtgtacttactgtgcgagagagtaaaggggattggtagataacg

SEQ ID NO: 17556 - DNA, 541 bp, Homo sapiens
  misc_feature: GYAE6OF02I1QEC.11.63.F08.1.454.CMB.1.raw
  modified_base (277)..(277): a, c, t, g, unknown or other
  misc_feature (277)..(277): n is a, c, g, or t
  modified_base (439)..(439): a, c, t, g, unknown or other
  misc_feature (439)..(439): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagctgggcctcagtgaaggtctcctgcaaggcttctggatacagcttcaccggctactatatgcactgggtncgacaggcccctggacgaagggcttgacggtggagtgggacggtatacgaacccgtaatacggtgggtagggacaacaaactatgcacgtaagaagtttggagggcagggtcatcagtcgaccgaggacacgtaccagtccagcacacgacctacagtgganctgagcgaggctcgactactcgtagaccgacgaccggcgtagttacttacgtggtacgacgaaggtagaacggtaaggggtattaggtacgtagttaaccgg

SEQ ID NO: 17557 - DNA, 549 bp, Homo sapiens
  misc_feature: GYAE6OF02JYBAJ.11.63.F08.1.454.CMB.1.raw
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtgggcctcagtgaaggtctcctgcaagggcttacgtggatacagcttcaccggctactatatgcactgggtgcgacaggcccctggacaagggcttgagtggagtgggacgatcaacctaatagtggtggcacaaactatgacacagtaaagtttcgggaagggtaccaggggttacagttacagttcgaaccgagggaccacggtaccatcgacgctaacagcctaacgatacggacgtacgtgaacgtcgaacggntacgagctacgtagaccgacgacgaccgttgtacttacgngtcgacgtagacgagtaaagggngttaggtanagttaacg

SEQ ID NO: 17558 - DNA, 506 bp, Homo sapiens
  misc_feature: GYAE6OF02JE9RZ.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgaggcaggtcatcatgacagggacacgtcatcagcacagcctacatggagctaggagcgaggctagactagtctagacgacgacggcgtgtacttacgtgtacggacgaggaggtaagtaaaggggtattaggtagagttaacgg

SEQ ID NO: 17559 - DNA, 582 bp, Homo sapiens
  misc_feature: GYAE6OF02GUE2S.11.63.F08.1.454.CMB.1.raw
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctgggctggaggtgaagaagcctggggcctcagtgaaggtctcctgcaaggcttcgtggatacagcttcaccggctactatatgcacgtggggtgcgacgacggccccgtggaccgaagggtccttaggaggtgggagtcggggacgtataccgaacccgtaagtggtggtaggaccaacgtaaacgtatgacagaaggtaagtttggagggcagggtactagtcagtcgaccgagggaccacgtccagtcagaccacgacgacctacgagttagggancgtacggagccgacggtnacgtacacgtcgtaggaccgacgtcgggtacgtagtacgttcgtagtcggacgtagaaggtaacggtaaggggtattaggtacgtacgtacgttaaccg

SEQ ID NO: 17560 - DNA, 453 bp, Homo sapiens
  misc_feature: GYAE6OF02FQAZ9.11.63.F08.1.454.CMB.1.raw
  modified_base (441)..(453): a, c, t, g, unknown or other
  misc_feature (441)..(453): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgacagggacacgtccatcagcacagcctacatggagctgagcgggctggcaaggcacgatagnnnnnnnnnnnnn

SEQ ID NO: 17561 - DNA, 535 bp, Homo sapiens
  misc_feature: GYAE6OF02F9SF4.11.63.F08.1.454.CMB.1.raw
  modified_base (354)..(354): a, c, t, g, unknown or other
  misc_feature (354)..(354): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacgacggcccctggacaagggcttggagtggagtgggacggatacaaccctaatagtggtggcaacaaactntgacaacagtaagtttggaggcgagggtcatcatgaccgagggacacgtccatcagcacacgacctacagtaggacgcgtaggagacgacgggcgtacgaactagtcgtagaaccgacgaccggccgtagtaacgttactggtcgacgagagaaggtaaaggggtattggtagattaacgg

SEQ ID NO: 17562 - DNA, 550 bp, Homo sapiens
  misc_feature: GYAE6OF02HVR9F.11.63.F08.1.454.CMB.1.raw
  modified_base (511)..(511): a, c, t, g, unknown or other
  misc_feature (511)..(511): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcgagtgaaggtctcctgcaaggcttctggatacagcttcaccggctactatatgcactggggtgcgacacggcccctggacgaagggcttggagtggagtggggacggagtaccaaccttaagtaggtgggtcggacaacaactatcgacacgaagtaacgtttaggagggacgaggggtacagtcaagtcgaaccgaagggacacgtaccatcgagacacgacgacctaacagtggagacgtggacgcgagcgagacgacgtcgacgacgacgacggtcgtagtactgtgngacggagacggaaggtaaggagttaggtcgtagtaaccg

SEQ ID NO: 17563 - DNA, 522 bp, Homo sapiens
  misc_feature: GYAE6OF02IVKVJ.11.63.F08.1.454.CMB.1.raw
  modified_base (280)..(280): a, c, t, g, unknown or other
  misc_feature (280)..(280): n is a, c, g, or t
  modified_base (421)..(421): a, c, t, g, unknown or other
  misc_feature (421)..(421): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtncgacaggcccctggacaagggcttgagtggatgggacggatcaacctaatacgtggtaggcacaaaactatgcacagtaagtttagaggggcagggtcatcatgaccagggacacgtcatacagcacagaccacgatgganctagaagcgagctagacatactgaacgtaccacgggtcccgttagtaacttacgttgagtaccgtaaggacgtaagaaaggggtactggttagattaacgg

SEQ ID NO: 17564 - DNA, 731 bp, Homo sapiens
  misc_feature: GYAE6OF02JYBK0.11.63.F08.1.454.CMB.1.raw
  modified_base (291)..(291): a, c, t, g, unknown or other
  misc_feature (291)..(291): n is a, c, g, or t
  modified_base (383)..(383): a, c, t, g, unknown or other
  misc_feature (383)..(383): n is a, c, g, or t
tcagcgagagataccacgaccggtgctcgatttagcgatcgtataagggggaggcgatcacccagcaaccacatctgtcctctagagaatcccctgagagctccgttcctcaccatggactggacctggaggatcctcttcttggtggcagcagccacaggagcccactccaggtgcagttggtgcagtctggggctggaggtgaaggagcgtggggcctcagtgaagggtctcctgcaaggtcttctggatacaggcttcaccggctactatatgcacgtgggtgcgacncggccctggacgaagggcttaggagtgggagtcggggacggtaacgtaccaaaccgtaacgtaggtagggtacggcgtaacgaaaaccgttntacggacgtaacgaacggttaaaggtttaggaacggggtaccgtagggttacgaacgttacgtaacgttacggaaccggtaacgggacgtaaccggttaccgaagttaccgaaggacccgtaacgaacggaccgttaaacgacgttacggggactaccggttagaaccgggtacgaacggggtaccgttacggaaacctacggtaccgttaacggaaccggtaaccggtacccggggaccggtttaccggttaaggttttaacccgtagggttaacggtacggaaagggtaaccggtaaaggttaaaggggggttactttagggtaacgggttaacgttaaacccggg

SEQ ID NO: 17565 - DNA, 501 bp, Homo sapiens
  misc_feature: GYAE6OF02F86UI.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactggtgcgacaggcccctggacaagggcttgagtggatgggacggatcaaccctaatagtggtggcacaaactatgcacagaagtttgagggcagggtcatcatgaccgagggacacgtccatcagcacagcctacatggagctgagcgaggctgacatctagacgaccgacggccgtagtaactacgtgtggcgagaggaagtaaaggggattggtagagttaacgg

SEQ ID NO: 17566 - DNA, 524 bp, Homo sapiens
  misc_feature: GYAE6OF02HTT7I.11.63.F08.1.454.CMB.1.raw
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagtcttcaccggctaactatatgcacgtgggtgcgacacggcccctggacgaaggcttgagtggagtgggacggatcgaacctaagtagtggtgcaacaactatgcacgagtaagtttgaggtcagggtcatcatcgacaggacacgtcatcgagacacacgactacagnggagacgtgacgcgacggctagaccngtcacgtacgacgacggtacgtcgtaacgttactgtcgacgacggaagtacggtaagggtatttagtagtagttaacg

SEQ ID NO: 17567 - DNA, 647 bp, Homo sapiens
  misc_feature: GYAE6OF02JHRI9.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtgggcctcagtgaaggtctcctgcaaggcttctggatacagcttcaccggctactatatgcacgtgggtgcgacacggcccctggacgaagggcttggaggtggagtgggacggagtaccaaacccgtaagtaggtgggtcggacaacaaaactatacgactacgagtaaaggtttggagggacgaagggtcatacgtaagtcgaaccggagggaaccacggtaccctagtaccgagaccaacgaacgacccttaacgacgtagggacgtactacggacgacgaacgggacgttacgaacctaacgttaccgtacggaaccgggaccgacccgggttaccggtagtttaacggttacgtacgggttcggaccggtaaagggaaggttaaacgggttaaaagggggttatttagggttacggtaacgtttaaccggg

SEQ ID NO: 17568 - DNA, 513 bp, Homo sapiens
  misc_feature: GYAE6OF02HOINW.11.63.F08.1.454.CMB.1.raw
  modified_base (340)..(340): a, c, t, g, unknown or other
  misc_feature (340)..(340): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggccccctggacaagggcttgagtggatgggacgatcaacctaatagtgtggcanaaactatgcacagaagtttgagggcagggtcatcatgaccgagggacacgtacatcagcacgagcctacagtaggagctgagcgaggctagacatctagacgacgacggccgtaggtaattacctggtgacggaaggagaaggtaaaacggggtatttaggtagagttaacgg

SEQ ID NO: 17569 - DNA, 639 bp, Homo sapiens
  misc_feature: GYAE6OF02H0OAM.11.63.F08.1.454.CMB.1.raw
  modified_base (247)..(247): a, c, t, g, unknown or other
  misc_feature (247)..(247): n is a, c, g, or t
tcagcgagagataccacgaccggtgctcgatttagcgatcgtataagggggaggcatcacccagcaaccacatctgtcctctagagaatcccctgagagctccgttcctcaccatggactggacctggaggatcctcttcttggtggcagcagccacaggagcccactcccaggtgcagttggtgcagtcgtgggctgaggtgaagaagcgtggggcctcgagtgaaggtctcctgcaaggcttcgnggatacgagtcttcgaccggtctacctatatacgcacgtgggtgcgacaggcccctggacgaggtctgagtggagtgggacggacacgaacctaatacggtggtggacgaacaaactagtagacaacgtaagtaaggtttaggacgggacggtagggtactaagtactagtacggaacgaacgggacaacgttaccgaagtcaacgacgaacctacggacctaacgtacgtcggaacgccgttaggaaacgccggtaacggacgttaccgaaataccgtacgtaaccggaacggtaacgacccggggtcggtttacgtaacgtttacggtgggtacgtaccggaaggttacggaaaggttaaagggtagtttacggtagtaacgttaaccgg

SEQ ID NO: 17570 - DNA, 524 bp, Homo sapiens
  misc_feature: GYAE6OF02JIIZ9.11.63.F08.1.454.CMB.1.raw
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
  modified_base (507)..(507): a, c, t, g, unknown or other
  misc_feature (507)..(507): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggagtgggacggatcaaccctaagtacgtgggtggcacaaactanagcacaagaacgtttgaggcagggtcatcatgaccgagggacacgtccatcagcacgagcctanagtggagctgagcgaggctgacagtccagtaaccgacgacggtccgagttacttacgtggtcgtaccgaagtaggtaagtaaacggggtnttaggtagtagttaacg

SEQ ID NO: 17571 - DNA, 576 bp, Homo sapiens
  misc_feature: GYAE6OF02IR01M.11.63.F08.1.454.CMB.1.raw
  modified_base (249)..(249): a, c, t, g, unknown or other
  misc_feature (249)..(249): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacgcccactcccaggtgcagttggtgcagtcgtggggctggaggtagaagaagccgtgggcctcgagtgaaggtctctgcgagcttcgnggactacagcttccgaccggtctactatagtgctacgtgggtcgcgacgacggcccctaggaacgagggtctggagtggagtgggacgtatacgaacctagtagtggcgacaactaatatcgacaagagtagttggacggtacgtagggtcatcgagtacgaccgagggacaccgtacatccgagcacgacgacctacgagtgacgtcgtagacgacgagctacgactagtcgtaagaccgaccgacgggtaccgttagttaacttacgtgtccggaacgtaggaacggtaacgggtaagggtagtttaacggtagtagttaaccgg

SEQ ID NO: 17572 - DNA, 532 bp, Homo sapiens
  misc_feature: GYAE6OF02F70NV.11.63.F08.1.454.CMB.1.raw
  modified_base (413)..(413): a, c, t, g, unknown or other
  misc_feature (413)..(413): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcgagtgaaggtctcctgcaaggcttctggatacagcttcaccggctactatatgcactgggtgcgacaggcccctggacaagggcttggagtggatgggacggatccaacctaatagtggtggcacgaaactatgcacagaagtttggacgggcagggtcatacagtagaccgagggacacgtaccatcagcacncgcctacagtggagctagagtccgaggcttgactatctagacgacgtccgggccgttggtaacttacgtcggtcgaccggagtacggaaggttaaaggggatttagggtgagttaaccg

SEQ ID NO: 17573 - DNA, 567 bp, Homo sapiens
  misc_feature: GYAE6OF02GJEUC.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactccccaggtgcagttggtgcagtctggggctgaggtgaagaagcctggggcctcagtgaaggtctcctgcaaggcttctggatacagcttcaccggctactatatgcacgtgggtgcgacgacggccccgtggacgaagggcttaggagtggagtgggacggactacaacccgtaagtaggtggtggacacaaactatacgacaacgagtaaggtttagagggcagggtcagtcagtagaccgagggacacgtccatcgagcaacacgacctacagtagacgtcgtggacgacgaggcgtacgaacacgtacgtagaaccgacgtacggccggttagtaacttaccgtaggtcggacgtaaggtaggtaacggtaaaggggtatttggtagagttaaccgg

SEQ ID NO: 17574 - DNA, 553 bp, Homo sapiens
  misc_feature: GYAE6OF02IZFH7.11.63.F08.1.454.CMB.1.raw
  modified_base (439)..(439): a, c, t, g, unknown or other
  misc_feature (439)..(439): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagcctggggcctcagtgaaggtctcctgcaaggcttctggatacagcttcaccggctactatatgcacgtgggtgcgacgacggcccctggaccaagggcttggagtggagtgggacggataccaacctaagtagtggtgacaacgaaactatcgacacgtagtaagtttgacggggctagggtcagtcgagtcgacgaagggacacgtccagtccagtcaacacgtacctacncgtacggagactggacgcgaggcctagacgtagtactcggacgaccgacgggccgttagttacttagtggtgacgtaggaacgtaaggtaagggtattcggtagagttaaccgg

SEQ ID NO: 17575 - DNA, 523 bp, Homo sapiens
  misc_feature: GYAE6OF02GF2XR.11.63.F08.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtncgacaggcccctggacaagggcttggagtggatgggacggatccaaccctaataggtggtggacacgaaactatgcaagagtaagtttggaggcagggtcatcatgaccagggacacgtcatcagcacacgacctanagtcggagctggancgagctagacatcgngaccgacacggtcgtagttaacttacgtgtcggacgaggtaaggaagttaaaggggntttagggtagtagttaaccg

SEQ ID NO: 17576 - DNA, 584 bp, Homo sapiens
  misc_feature: GYAE6OF02HEACX.11.63.F08.1.454.CMB.1.raw
  modified_base (489)..(489): a, c, t, g, unknown or other
  misc_feature (489)..(489): n is a, c, g, or t
  modified_base (546)..(546): a, c, t, g, unknown or other
  misc_feature (546)..(546): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacgcccactcccaggtgcagttgggtgcagtcgtggggctgaggtgaagagccgtggggcctcgagtgaaggtcctccgtgaccgaaggtcttcgtggatacgagtcttcgaccggctaacgtatatcgacgacgtggggtgacgacgaccggcccctagggaacaacggggtcttaggaggtggagtggggacggactacgaaacctaagtaggtggtcgactaaacaactagtgacacgtaagttaaggttggacggggacgtagggtcatcagtacggaccgtaacgggacacctcagtacagacaaccgagactacgagtcggancgtagacgacgcgactgatacgcagacgacgaggtccgttatacttacgtggcgganaggaaagtacgggtaaaggtggtttgacgtataaccgg

SEQ ID NO: 17577 - DNA, 586 bp, Homo sapiens
  misc_feature: GYAE6OF02JER58.11.63.F08.1.454.CMB.1.raw
  modified_base (437)..(437): a, c, t, g, unknown or other
  misc_feature (437)..(437): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctgggcctcagtgaaggtctcctgcaaggtcttctggatacagtcttcaccggctactatatgacactgggtgcgacaggcccctggacaacgggctttgagtcggagtgggacggatccaaaccctaagtagtgggtggacacaaaacgtagtcgacacgaagtaagtttggaaggtccgagggtcatcatgaacgagggacacgtcatcgagcacagtccctacgntcggaacgtgtcgaagcgaggtctaggaactacgtctacgaacgtaccgaccgggtccgttacggtaatttacggtcgggtacgtaccgggtaaggtaaccggtaaagggttaaacgggtaggtttacggaacggtagtttaaacccgg

SEQ ID NO: 17578 - DNA, 617 bp, Homo sapiens
  misc_feature: GYAE6OF02F9QE5.11.63.F08.1.454.CMB.1.raw
  modified_base (283)..(283): a, c, t, g, unknown or other
  misc_feature (283)..(283): n is a, c, g, or t
  modified_base (596)..(596): a, c, t, g, unknown or other
  misc_feature (596)..(596): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagagccgtggggcctgagtgaaggtctcctgcgaaggcttcgtggatacagcttcaccggctactatatgcacgtgggtncgacgacggccccgtggaccgaagggcttggaggtggagtggggacgtagtaccaaacccgttaagtacggtgggtcggacaacaaaacgttagtgactaaccgaaggtaaggttttggaaggggactaaggggtcaagtacacgtagaacccgagggacctaccggtacctaagtaccgaagaccgaacgacgtaccctaagacgtggacgtcgtaggacgcgaggtcgtacgacgtactcgtagaaccgaccgaccgggtaccgtaggttaacgttacgtggtgacggtaagtacggaaggttaaagggtntttacggtagtaagttaacgg

SEQ ID NO: 17579 - DNA, 629 bp, Homo sapiens
  misc_feature: GYAE6OF02IZ8D5.11.63.F08.1.454.CMB.1.raw
  modified_base (288)..(288): a, c, t, g, unknown or other
  misc_feature (288)..(288): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcgagtgaaggtctcctgcaaggcttctggatacagcttcaccggctacgtatatgcactgggtgcgaacncggcccctggacaaggcttgacgtggatgggacgtatacgaaccgtaatacggtgggtagacgaacaaaactgtacgacgacaagtaagtttggagggccgtaagggtacaagttcgaagtcggaaccggaacgggaacctaccgtaccaagttaccgaagtaccgaaccgaacgaccctaacgacgtagggaacgtcgtaggaccgacgacgggccgttaagacgaacgttcgtacggaccgaacgtaccggtcccggttagttaacgttaaccgtggttacggaccgtaaggtaacgtaacggttaaaggggtaacgtttcggtaggtagttaaaccgg

SEQ ID NO: 17580 - DNA, 519 bp, Homo sapiens
  misc_feature: GYAE6OF02H70K0.11.63.F08.1.454.CMB.1.raw
  modified_base (279)..(279): a, c, t, g, unknown or other
  misc_feature (279)..(279): n is a, c, g, or t
  modified_base (432)..(432): a, c, t, g, unknown or other
  misc_feature (432)..(432): n is a, c, g, or t
tcagcgagagataccacgaccggtgctcgatttagcgatcgtataaggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtggtncgacacggcccctggacaagggccttggagtggagtgggacggatcaaccctaatagtggtggcacaaactagtgacacagaagtttgaggcagggtcatcatgaccaggacacgcatcagcacagccacatggagctgagcgaggctagacntacctgaacgcaccggtccggtagttacttacgtggtagtcggaaggaagtaacggtaaaggggtactttaggtagaagttaaccgg

SEQ ID NO: 17581 - DNA, 551 bp, Homo sapiens
  misc_feature: GYAE6OF02I68FB.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacacggcccctggacaagggcttggagtggagtggggacgatccgaaacctaagtagtggtggacaacaactatgacacagtaagttggagggtcgagggtacagtctagtcgaccgagggacacgtaccatccagccacgacgtacctacgagtcggagtcgtaggacgacgaggctagaactatacgtagaccgacgacggaccgtagtaacgttacgtaggtcgagagtaggtaaggtaagggtagtacggtagtagttaaccgg

SEQ ID NO: 17582 - DNA, 522 bp, Homo sapiens
  misc_feature: GYAE6OF02GJDEV.11.63.F08.1.454.CMB.1.raw
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (502)..(502): a, c, t, g, unknown or other
  misc_feature (502)..(502): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactggtgcgacaggcccctggacaagggcttgagtggatgggacggatccaacctaatagtggtggcaacaaactatgcacagaagtttgagggcagggtcatcatgacgaggacacgtccatccagccacacgacctanagtggagctggagcaggctagacnctcgtagaccgacgaccggccgtagttaacttaactggtacgcgaggaaggaaggttaaacggggntttaggtacggattaaccgg

SEQ ID NO: 17583 - DNA, 643 bp, Homo sapiens
  misc_feature: GYAE6OF02H5Z6L.11.63.F08.1.454.CMB.1.raw
  modified_base (184)..(184): a, c, t, g, unknown or other
  misc_feature (184)..(184): n is a, c, g, or t
tcagcgagagataccacgaccggtgctcgatttagcgatcgtataagggggcagtcacccagcaaccacatctgtcctctagagaatcccctgagagctccgttcctcaccatggactggacctggaggatcctcttcttggtggcagcagccacaggagacccactcccaggtgcagttggtncagtcgtgggctgaggtgagaagccgtgggcctcagtgaaggtctacctgcaaggtcttctggatacagtcttcaccggctaactatatgcacgttgggtcgacggaccgacggccccgtaggacgagggtcgttaggagtcgggagtggggacggagtaccgaacctaagtaggtggtaggacaactaacgtagtgacgacgtaaggtaagtttaggacgggtacgagggtacagtcgaagtacgaaccgaagggaccacgtacacgtacaggaccacgacgacctagacgtcggacgacgtaggagacgacggtactcggaacgtaacgtcgtacggaaccgtaaccgtccggtaccgttacgttaacgtttccggtacgggttacggaacggtaaggaacggttaaacggtaacggggtacgtttacggtaacggttacgtaaccggttaacccgg

SEQ ID NO: 17584 - DNA, 532 bp, Homo sapiens
  misc_feature: GYAE6OF02FRBC5.11.63.F08.1.454.CMB.1.raw
  modified_base (486)..(486): a, c, t, g, unknown or other
  misc_feature (486)..(486): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacacggcccctggacgaaggcttggagtggagtgggacgatcaacctaagtaggtggtggcaacaaactatgacaacgagtaagtttggagggcgagggtcatcagtgaccgagggacacgtccatcagcacacgcctaacacgtggagtctagacgcgaggctagactacgtctacggacgacgacggtccgtagtacgtttcgnggtcgacgagaaggtaagtaagggtattaggagtagtacgtaaccg

SEQ ID NO: 17585 - DNA, 700 bp, Homo sapiens
  misc_feature: GYAE6OF02GWC16.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgcaggttggtgcagtctggggctgaggtgaagagccgtggggcctcagtgaaggtctcctgcaaggtcttctggataccagcttcaccggtctacgtatatgcacgtggtgcgacgacggcccctggacgaagggcttggaggtcggagtggggaaccggtatacccgaaaccctaagttacggtagggtacggtaccaaaccgtaaaacttagtacggacctaaacgtaacggtaaaggttttacgggaacggggtactaagggggttaccctaagttacccaaggttaccggaaaccccgaagggggtaaaccctaacgggtaccctaagttaccgaacgtaccgaaacctacgggaccccttaaacgacggttagggaaacgtcggtaaggaaccgggccgtaagggtccgtacgaaccgtagtcgtaacgaacgacgccgggtacctacggttatttaccgtggtacgcggtaagggacgttaagggtaaacgggtatttagggtaggtaacgttaaccgg

SEQ ID NO: 17586 - DNA, 659 bp, Homo sapiens
  misc_feature: GYAE6OF02JGHD4.11.63.F08.1.454.CMB.1.raw
  modified_base (229)..(229): a, c, t, g, unknown or other
  misc_feature (229)..(229): n is a, c, g, or t
  modified_base (638)..(638): a, c, t, g, unknown or other
  misc_feature (638)..(638): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcgagtgaagntctcctgcaaggcttctggatacagcttcgaccggtctactatatgcacgtgggtgcgacacggcccctggacaaggcttgagtggagtgggacggataccgaacctaagtaggtaggtacggactaacgtaaactagtcgacgaactaaggtaaggtttaggacgggtacgacggggttaccaagtacgaagttacggaaccggaacggggtaaccaccgttaccaagtaccgagaccaccgacggtaaccctagtacggtacggacgtacgtaggacggacggaagggtcctacgaacgtcgttacggtacgaccggtaccgaacccgggtaccgttacgggttaacttacggtacgggttacgtaacggaaacgggttaacgggtaaacgggttaaaacgggggtntttacgggtaggttaaaccgg

SEQ ID NO: 17587 - DNA, 717 bp, Homo sapiens
  misc_feature: GYAE6OF02JM8HQ.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatctcttcttggtggcagcagccacgaggagcccactcccaggtgcagttggtgcagtcgtgggctgaggtgaagaacgccgtgggcctcgagtgaacggtctccgtgcaaggcttcgtggatacagtcttcgaccgtctacgtatacgtgctacgtcgggtgccgaaccgaccggccccgtaggaaccggtaacgggtccgttaggacggttagggtaggtcggggaaccggtactaacccgtaaacccgttaaggttacggtagggttacgaccgaaccgtaaacgtacgtacgacaaaccgtaagtaaggtttacgggtacgggtacgggaacggttacggacgtaacgtacggtacgaaccggtaaccggacctaacggtacctacgtacgacgactaaccgacgacccgtaagtacgtaggacggtacgtacgacgaggtaccgtcgtaacgaccgttacgtacgccggtaacgacccggaccggtaccgttacggtaacgttacggtcgggttcggaacggttaacggaagggttaaacggtaaggggttaagtttacgggtaacggttaacgtaaccggg

SEQ ID NO: 17588 - DNA, 603 bp, Homo sapiens
  misc_feature: GYAE6OF02GHX6H.11.63.F08.1.454.CMB.1.raw
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
  modified_base (582)..(582): a, c, t, g, unknown or other
  misc_feature (582)..(582): n is a, c, g, or t
tcagcgagagataccacgaccggtgctcgatttagcgatcgtataagggggaggcatcacccagtcaaccacatctagtcctctagagaatcccctgagagctccgttcctcaccgatggactggacctgggaggatcctcttcttggtggcagcagccacaggacgtcccactcccaggtgcagttggtgcagtctggggctgaggtgaagagcgtggggcctcagtgaaggtctcctgcgaagcttctggatacagccttcgaccggctacctatactgctacgtgggtcgcgacgaccggccccgtaggaccgaagggtcttggacggttggagtaggggacggtataccgaaacccgtaagtacggtgggtacggaccaacgaaacgttatacgacacgtaaggtaacgtttagggaggggtacctaagggtcattacgagtcggaaccgagggacctacgtaccagtccacggaccacgacgcctagacgtcggacncgtagacgcgaggcgtacgacncttcgtacgacgaccgccgtcgtagtcttacgtggcgacgaagacgaggtaacgggtnttacggtacgtagttaaccgg

SEQ ID NO: 17589 - DNA, 576 bp, Homo sapiens
  misc_feature: GYAE6OF02ILCB5.11.63.F08.1.454.CMB.1.raw
  modified_base (359)..(359): a, c, t, g, unknown or other
  misc_feature (359)..(359): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagctggggcctcagtgaaggtctcctgcaaggcttcgtggatacagtcttccgaccggtctactatatgcacgtgggtgcgacacggcccgtggacaagggcttgagtggagtgggacgatcaacctaatagtggtgacacaactatagacanagtaagtttaggaggacgagggtacagtcgatagaccgagggacacgtcatcagacacacgactacacgtggacgcgtagagacgacgggtacgtagaactacttacgtacggaaccgtaccgaccggtaccgttaggttacgtttaaccgtggtaccggtacgtaacggtaaggtaacggttaaaggggttacgttaggttacgtaggttaaccgg

SEQ ID NO: 17590 - DNA, 656 bp, Homo sapiens
  misc_feature: GYAE6OF02HVOKQ.11.63.F08.1.454.CMB.1.raw
  modified_base (527)..(527): a, c, t, g, unknown or other
  misc_feature (527)..(527): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtcgctaggttggtgcagtcgtggggctggaggtgaaggaagccgtggggcctcgagtggaaggtcctccgtgcgtaaggtcttcgtaggatacgagtccttcgaccggcttaactatatgcacgtgggtacgcgacgcggccccgtggacgaggctggagtggagtaggacgatacgtaacctaagtaggtggtagacgaactaactagtacgactaacgaagttaacggtttgggacggggacacggggttactaacgttacgaagtaccggaacggaacgggaacctaccggtaaccagtaccgacgaccaacgtaaccgtactaacgagtggactcgtagacggtaccgnggtacgtacgacgtacgtacgaccggtaaccgaccggtacggtaccggttagttaaccgttacggtggtacccggaaggtaacggtaaggtaaagggtaagggttagtttagggtagtaacgttaacgg

SEQ ID NO: 17591 - DNA, 608 bp, Homo sapiens
  misc_feature: GYAE6OF02I3F1W.11.63.F08.1.454.CMB.1.raw
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactccccaggtgcagttggtgcagtctggggctgaggtgaagaagccgtggggcctnagtgaaggtctcctgcaaggcttcgnggatacagtcttcaccggctactatatgcagtggtgcgacgacggccccgtaggaccgaagggcttagaggtggagtgggacgtataccgaaacctaagtagtcggtgaccaactaaactatacgacaacgtagtaagtttaggaacgggcgagggtactagactagtacgaaccgagggtacaccgtaccacgtacgacgaccgaacgacgtacccgtacgacgtacggtacgacgtggacggcgacggcgtacggacgtacgtacacggaaccgtaccgacggtccgtaggttaacttaccgtgtacggacgtaacggtagaacgggttaaggagtttacgggtagtaacgttaaccgg

SEQ ID NO: 17592 - DNA, 696 bp, Homo sapiens
  misc_feature: GYAE6OF02I653W.11.63.F08.1.454.CMB.1.raw
  modified_base (236)..(236): a, c, t, g, unknown or other
  misc_feature (236)..(236): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgcagttggtgcagtcgtggggctaggaggtgaagacgccgtgggcctcgaggtgaaggtcnccgtgacgaaggtcttgtaggatacgacgtcttccgaccggtactactatagtcgcgacgtgggtcgcgaaccggtcggccccgtaggaaccgaacgggtcttaggacggtagggacgttaggggacggtactacgtaaaccctaaggtacggtgggtacgacaacgtaactagtcgacaacgtaagtagttaggacgggcgtagggtacaagtaccgtaagtacggaaccgacgggtaacctacgtactacgtaacgacgaccgtaccgaacgtacgtaaccgtaagtcgggtaacgcgaacggtaccgacgaacggtcgtacgaaccgttacttacggaacggtaaccgacggtcgtacggttacgttaaaccgttcggtagtaccgggtaacggtaacgggtaaacggttaacggggttaaacggttacgggttaacggttagtaaccgttaaccgg

SEQ ID NO: 17593 - DNA, 592 bp, Homo sapiens
  misc_feature: GYAE6OF02F9GDI.11.63.F08.1.454.CMB.1.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttctggtggcagcagccacaggagcccactcccaggtgcagttggtgcagtctggggctgaggtgaagaagcctggggcctnagtgaaggtctcctgcaaggcttcgtggatacagcttcaccggctactatatgcacgtgggtncgacacggcccctggacaagggcttgaggtggagtgggacgataccaacccgtaataggtcggtaggacaacaaactatcgacacgagtaagtttaggagggtcgagggtcatactagtagaccgagggaccaacgtccagtacagcaagacgcctacgagtaggaggtcgtagaggacgacggacgtacgaccgactacgtacggaaccgaccgtaccggtacggtcgttaacgttacggttcggtacgtacggaacggtaaggtaaacggtaaagggggttaatttacggttaggtaagtttaacccgg

SEQ ID NO: 17594 - DNA, 662 bp, Homo sapiens
  misc_feature: GYAE6OF02GR1U2.11.63.F08.1.454.CMB.1.raw
  modified_base (619)..(619): a, c, t, g, unknown or other
  misc_feature (619)..(619): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcaggttggtgcagtcgtggggctggaggtgaagaagccgtcggggcctcgagtcgaacggtcctccgtgcgaaggcttacgtggatacacgtcttccgaccggctactatatgacacgtgggtcgcgacgacggccccgtaggacgaacgggtcttggagtagggagtggggacggataccaaaccgttaagtaacggttggaggacaacgtaaactagtacgacgaactaacggtaagttttaggggaacggtcgtaaggggtacctagtactacggtacgtaaacccggaacgggggtaaccaccgggttacctaacgtaccggacgtaccgaacgtacggacccttaacgacgtacgggaacggtcgtaggtaacgggaccgggtacgtcggtacgaacgtcgtaacggtacgaacgcgtacggtcttacggtagttaccnggtacggacaggtaacgacggtaaggagttggaagtgtaacgg

SEQ ID NO: 17595 - DNA, 592 bp, Homo sapiens
  misc_feature: GYAE6OF02G00OA.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagccgtggggcctcgagtgaaggtctcctgcaaggcttctggatacagtccttccgaccggtctactatatgctacgtgggtgcgacacggcccctggacgagggtcttggagtggagtggggacgataccaacctagtgtggtgacaacgaactgtgacagaagtaggttggacgggcgagggtcagtcgatacggaccgagggacctaccggtccaataccgacgaccaaccgtacgtaccctaacgagtcggacgcgtggacgtcgacggtcgtacgaacgtacgtcgacggaccgacgtaccggtcgttagtacgtttacgtggtacggacgtaaggtacggtaagggtaaggggttagtttacggtacggtagttaaccgg

SEQ ID NO: 17596 - DNA, 782 bp, Homo sapiens
  misc_feature: GYAE6OF02GUGIZ.11.63.F08.1.454.CMB.1.raw
  modified_base (246)..(246): a, c, t, g, unknown or other
  misc_feature (246)..(246): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggacgcccactcccaggtgcagttggtgcagtcgtgggctgaggtgaagaagccgtgggcctcgagtgaaggtctccgtgcaaggtcttcnggatacgagccttcgaccggctaacgtatatgcctagtgggtacgccgtaacgaccggcccgtggaaccgaacggggtcttaggtacggtggaagtcggggaacggtactaccgtaaaaccgtagttaggtacggtcggaaccgtaaactaaacgtacgttacgaccgtaaacgtaagggttaaacggttttaggggaaccgggtacggtaaccgggttactaacgtaccggtaaacgtccgggttaaaccccggaagggggtaacccttaaccgggttacccaacgttaaccggtaaaccgaacccttaaaccggaacccggtttacccgtaaacggttcggttaaacggggaccttaccgggttaagggaaccgggaaccgtacggggtcgtaacgaaccggttcgtaaccgttacggaaaccggacgttaccgggtaccgttacgttaacgtttacgacgggtacggtaaccgaaggtaacgggttaaaggtaacggggttactttggaaacggttacgttaccccgttaagg

SEQ ID NO: 17597 - DNA, 564 bp, Homo sapiens
  misc_feature: GYAE6OF02GZUI5.11.63.F08.1.454.CMB.1.raw
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagagccgtggggcctcagtgaggtctcctgcgaaggtcttcgtggatacagcttccgaccggctactatatgcacgtgggtcgacgacgacggcccccgtagggaccgaaggggcttggagtggagtgggacggatacgaacctaataggtggtagacacaaactagtcgctagagtagttggaggcgagggtcagtcagcggacgagggacncgtacatcgacgcacgacgacctacgngtggacgtctagagcgtagctagacncgttaccgagacgaccgacggtccgtagttacttaccgtgtacggacggaacgtaaggaagggtaagggttaggttagtacggtagttaaccgg

SEQ ID NO: 17598 - DNA, 646 bp, Homo sapiens
  misc_feature: GYAE6OF02JLXB4.11.63.F08.1.454.CMB.1.raw
  modified_base (562)..(562): a, c, t, g, unknown or other
  misc_feature (562)..(562): n is a, c, g, or t
  modified_base (577)..(577): a, c, t, g, unknown or other
  misc_feature (577)..(577): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctgggctgaggtgaagagccgtgggcctcgagtgaaggtctcctgcaaggcttcgtggatacagtccttcgaccggtctactatagttcgactacgtgggtcgtacgaaccgacggtccccgttggaaccgtaagggtccgttaggaggtgggtacggtggggaaccgggactaccgtaaacccgttaagtacggttacgggtacgtaaccgaaacgtaaaccgtgtacggtacaaacgtaagggtaaaggttttcggaaacgggtacgaaggggtttaccagtagtaaccgtacgaccggtaacggggacctaaccgtacgactacgagtaccgacacgtacccgtagaaggttacgagcgtacgagtaccgnggtactcgaatcganacgcgacgcggtctagtacgttacgcgcgaggtaacgaggtaacgtaaggtagttgtacggtataacgg

SEQ ID NO: 17599 - DNA, 693 bp, Homo sapiens
  misc_feature: GYAE6OF02HNQIA.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgagaagcctggggcctcagtgaaggtcctcctgacgaaggcttcgtggatacagtcttcgaccggtctacgtatatgcacgtggtgcgtacgacggcccgtaggacgaacggtcgttaggaggtcggaggtcgggacggactacgaaaccctaagtacggtgggtacggaccaacgaaacttagtacgacaacgtaaggtaacggttttagggaacggggtcggtaacggggtacgtaacgtacgtaacgttacggaacccggtaaggggtaacccgtaaccggtacctaagtacccgaacgaacccgtaaccgaaacgtccctaacgtacgtacggaaccgtcgtaagggacgacggtaaacggcgtaacgtaacgtacgtacgtacgaccggaccgtacggtaccggtttacgttaacgttacgtcggtacggtaggaaggtaacgggtaacggtaaggggttactttacgggtacgtagttaacccggg

SEQ ID NO: 17600 - DNA, 583 bp, Homo sapiens
  misc_feature: GYAE6OF02GP3UD.11.63.F08.1.454.CMB.1.raw
  modified_base (379)..(379): a, c, t, g, unknown or other
  misc_feature (379)..(379): n is a, c, g, or t
  modified_base (458)..(458): a, c, t, g, unknown or other
  misc_feature (458)..(458): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccgaggtgcagttggtgcagtcgtggggctggaggtgaagaagccgtggggccctcgagtgaaggtctcctgacgaaggtcttcgtggatacagcttcgaccggtctaactatagtgctacgtgggtcgacgacgacggccccgtaggacgaagggtcttggagtggagtgggacgataccgaacctaagtaggtggtgacaacaactangacagaagtagttaggaggacgaggtcatcagtacgaccgagggacctacgtaccatcgacgcaacgacgtacctacgngtaggacgcgtaggacgcgagcgtacgactacgtccgacgaccgtaccgacggtccgttaggttaacgtacgtggtacgaggtaaggaaggtaaggtaaagggtgtttaggtagtacgttaacgg

SEQ ID NO: 17601 - DNA, 633 bp, Homo sapiens
  misc_feature: GYAE6OF02G30BT.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcacgtgggtgcgacaggcccctaggacagggtcttaggagtggagtgggacggataccgaaccctaagtacggtggggtacgactaacaacttagcgacgagtaaggttaggtttagggacgggcggtacgggtactacgtacgtacgtacggaaccggacgggaaccgtacgtaccgtactaccgacgaccgacgtaccgtacctaacgtacggtacggacggtacgtaggacgacggtacgtcgtacgacctcgtacgtaccgaccgacggtccggtacggttagttaccgttacgtgggtaacggtacggaaggtaacggtaacggttaaagggtcgtttaggtacggtattaacccgg

SEQ ID NO: 17602 - DNA, 634 bp, Homo sapiens
  misc_feature: GYAE6OF02IGJ3C.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacgaggacgcccactcccaggtgcagttggtgcagtctggggctggaggtgaagagccgtggggcctcgagtgaaggtcctcctgacgaaggcttcgtggactacagtccttcgaccggctactatatgcagtgggtgcgacgacggcccgtaggaccgaagggtcgttaggaggtaggagtaggggacgtatacctaacctaagtaggtggtagacaacaaactgtacgactaacgtaagtaacggtttggacgggtacgagggtactagtacgtacgtagaccggaagggaccgtacgtccaagtacccgaggtaccaacgtaaccggacccttaacgacgtacggacgtaccgagggaccgacgacgttcgaacgacctaacgtaccgtacgaccggacgaccgggtcgttacgtacgttacgtggtacgacggtaaggtaggtaagggtaagggtagttacggtagtagttaacgg

SEQ ID NO: 17603 - DNA, 849 bp, Homo sapiens
  misc_feature: GYAE6OF02GT00B.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccaggtgactacggtttggcgcgagttcgtggggcttggagggtagaagaacgccgtcggggacctcgaggtaggtaacggtcctaccgtgacgtaacggtctttcgtaggaactacacgtccttaccggaacccgtaccttaactaacgttactcggtacgtacggttacgggtacgacggaacccgaaccgggtaccccgttaaggggaaccgtaaagggggtcctttagggaacgggttgggaaacggttacggggaaccggtaacgtacccgtaaaaccgttaaggttacggtacgggtacggtaacccgtaaacgtaaaacgtacgttacggaaccgaagttaaacggttaagggtttacgggaacgggtaccgtaacggggtacttaagtaccggaagttaccggaaaccgtaacggggacctaccgttaaccgattaccggaacgtcgaaccctacggtacccgtacgtaaggtacgtacggtccgaaggtacggtaccgtacggggtcttaacggtaaccgacggtttaccggaacggaaccgtacccggggttaaccccggtaggttttaacccggtatttaaccggtaccgggtacggaaacgggttaaggtaacgggttaacgggtaaaacgggttccgtttaggttaaccgggttaacgtttaacccg

SEQ ID NO: 17604 - DNA, 660 bp, Homo sapiens
  misc_feature: GYAE6OF02GGOC0.11.63.F08.1.454.CMB.1.raw
  modified_base (384)..(384): a, c, t, g, unknown or other
  misc_feature (384)..(384): n is a, c, g, or t
  modified_base (639)..(639): a, c, t, g, unknown or other
  misc_feature (639)..(639): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagaagccgtggggcctgagtgaaggtctcctgcaaggtcttctggatacgagtcttccgaccggcttactatatgctacgtggggtcgcgaccgacggcccctaggaacgaagggtcttggaggtggagtggggacgataccgaaacctaagtaggtgggtacggacaaacgtaaaactntacgacaacgtaaggttaaaggtttcgggaaggggtacgtaaggggtactaacgtaccgagttacggaacccggtaacggggacctaaccggttaccaacgttacgaaccgaccgtaaacgacggtacccctagtaaggtacgggacgtacgttacggacgacggtaacggcgtacgacgtactacgtacgaaccgacgtaccggcgttagtacttacgtcggtacgaggagtaacggttaagggtaaacgggtnttagggtacgtagttaaccgg

SEQ ID NO: 17605 - DNA, 683 bp, Homo sapiens
  misc_feature: GYAE6OF02H7AF1.11.63.F08.1.454.CMB.1.raw
  modified_base (249)..(249): a, c, t, g, unknown or other
  misc_feature (249)..(249): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagcacaggagcccactcccaggtgcagttggtgcagtcgtgggctgaggtgaagaagccgtggggcctcgagtgaaggtcctcctgcaaggcttctggntacagcttcaccggctactatatgcacgtggtgccgacgacggccccgtggacgacggtcgttggagtgggagtagggacggatccgaaaccgtaagtagtcgggtggacaacgtaaacgtatagactacgtaagtaacggttttacggagggtacgtaacgggtcctaagtccgaagttaccggaaccgaacggggtacctaaccgtcccgtaatcgtacgacccgactacgtacctaaccaggtacggaacgcgtacggacggtccgaacgggtctaagggaacctacgtacgtaacggtaccgaccgggtaccggtccggtttaacggttaacgtttaacccggttgggtaacgggttaccggaagggtaacggtaaaggggttaaaacggggttagttttaagggtaccggttaaggtttaaaccccggg

SEQ ID NO: 17606 - DNA, 730 bp, Homo sapiens
  misc_feature: GYAE6OF02FWRVD.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggacgcccactcccgaggtgcagttggtgcagtcgtggggctgaggtgaagaagccgtgggcctcagtgaaggtctcctgcaaggtcttcgtggatacagtcttccgaccggtctactatatgctacgtgggtgcggacacggccccgtaggacgaaggggcttaggaggtgggagttggggacggactaccgaaacccttaagtaggtgggtcgacaacgaaactagtagacaacgaagttaaggtttaggaaggggtcgtaagggtactacgttacaagtacggaaccggaacggggtaacctaaccgggtaccaacgttaccggaacgaccgtaaaccgaccgtaacccgtaacgtaacggtacgggtacgtaccgttacgggaccggtaccggtaacgggtaccggtaacgtaaccgtacgttaccgtaacgggaacccggtaacccggtaccgggtacccggttaacggttttaacgttaccggttagggtaccgggtacgggtaaaggtaagggtaaacgggttaaagggggtttacttaagggttacggttaacggtttaacccgg

SEQ ID NO: 17607 - DNA, 720 bp, Homo sapiens
  misc_feature: GYAE6OF02F8ULV.11.63.F08.1.454.CMB.1.raw
  modified_base (592)..(592): a, c, t, g, unknown or other
  misc_feature (592)..(592): n is a, c, g, or t
  modified_base (626)..(626): a, c, t, g, unknown or other
  misc_feature (626)..(626): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcgttggtggcagcagccacgaggacgcccacctcccaggtgctaggttgtgcagtcgtgggctggaggtggaagaacgtccggtgggacctcgagtaggaacggttcctaccttggccgtaaggtccttcgtaggtaactaccgacgtccgttaccgaaccggtaccttaaccgttagtacgtcgacgtacggtggggtccgacgaccgtccgggaccccgttaggaaccggtaagggtccgttaggtacggtacggtaggtacggggacggtataacccgaacccgttaagtacgggtcggtaccgggtacaaaccttaaacggtagtacgacgtaaccgaaagttacggtttacggagggtaccgagggtactacgtacgtacggacgaaccgggtacgaccctaccgtacgacgtacgaccgtacgaacctacgacctagtcgtacggtanccggttagacgtaccgaggtccgtaacgtgtacncgtaaaccgcgtaccggacgtccgtttaagtctaaggttcgtcgggaagtacggtaaggacggttaaagggttctacggttagtaccggtaacg

SEQ ID NO: 17608 - DNA, 566 bp, Homo sapiens
  misc_feature: GYAE6OF02FLTQ5.11.63.F08.1.454.CMB.1.raw
  modified_base (430)..(430): a, c, t, g, unknown or other
  misc_feature (430)..(430): n is a, c, g, or t
  modified_base (548)..(548): a, c, t, g, unknown or other
  misc_feature (548)..(548): n is a, c, g, or t
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaggcttctggatacagcttcaccggctactatatgcacgtggtgcgacacggcccgtggacgaagggtcttggaggtggagtgggacggatccaacctatagtggtgcacaactatgacacagtaaggtttgaggggcgaggtctatacagtcgaccgagggtacaccgtccatcagccacgacgccctaacgtnaggacgtcgtaggagtacccgtaaggggtctacgggacctaataccgtacggaccgtaccggtaccggccgttaggttacgtacgtggtcgtacggacggagaacggtaaaggggttntaggtagtaagtaaccgg

SEQ ID NO: 17609 - DNA, 790 bp, Homo sapiens
  misc_feature: GYAE6OF02HSS4Y.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtagcagtcgtggggctggaggtagaagacgcgtggggcctcgagtgaaggtcctccgtgacgtaaggtcgttcgtaggtactacgagtcttcgaccggctactatagtgcacgtgggtcacggacgacggccccgtaggaccgaggtcgttggagtaggagtgggacgtactactaaccgtaagtacggtggtacgaacaacgaaactagtacgacgtaaccgaaggttaacggtttcgggaacgggtacggtaacggggtacctaacgttaccgtaagttaccgggaaccgggaacggggtaacccgtaacccggttaccctacggttacccgaaaccggtacctaaacccggtaaccggtaaccccttaaacggtaaccggtaagggtaccgaccggttaacggaaccggtacggtacggtaccggttaaggaacccttaacggttccgtaaccgggtaacccgggttaacccgggacccgggttacccgttttaacgggtttaaccggtttaccgttacgggtacgggtaacccggtaaaggtaacggggtaacgggtaaagggggtttaccgttaacgggtttaagtaacggttaaaccccggg

SEQ ID NO: 17610 - DNA, 765 bp, Homo sapiens
  misc_feature: GYAE6OF02G38KD.11.63.F08.1.454.CMB.1.raw
tcagcgagagataccacgaccggtgctcgatttagcgatcgtataaggggcatcacccagcaaccacatctgtcctctagagaatcccctgagagctccgttcctcaccatggactggacctggaggatcctcttcttggtggcagcagccacgaggacgcccactcccgaggtgacgtagtttggtgcagtcgtggggctggaggtagaagaagccgtgggcctcgaagtgaacggtcctccgtacgcgaaggtcttcgtaggactacagtccgttacgacccggtactaaccttagtacgtcgccgtaaccggttgggtccgacggtaaccgaacccgggtaccccgttagggaaaccgtaaaggggttccgttacgggtaaggtacgggaacggtacgggggtaaaccgtacgttaaccctaaacccgttaaagtacggttaggtccggtaacctaaacgtaaaacttacggtacgaactaacgtaaggtaaagtttagggagggtaccgtaagggtaccttaagaccgtacgtacgaaccgggtaggaacccggtactaccgaagtaccaacgacgacgtaccgacgttacgtagtacggtactacgtaggacgacgtacgcgtaggaactacgttaccggaacgaacccggtaccgtacgggtacccgttaacggttaacgttcggaggttcggtaacggaacggttaaggtaacgggtaacgggttagttacggacggttaaccgttaagtaaccccgg

SEQ ID NO: 17611 - DNA, 585 bp, Homo sapiens
  misc_feature: GYAE6OF02JA5X0.11.63.F08.1.454.CMB.1.raw
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
  modified_base (556)..(556): a, c, t, g, unknown or other
  misc_feature (556)..(556): n is a, c, g, or t
tcagcgagagataccacgaccggtgctcgatttagcgatcgtataagggggcatcacccagcaaccacatctgtcctctagagaatcccctgagagctccgttcttcaccatggactggacctggaggatcctcttcttggtggcagcagccacaggagcccactcccaggtgcagttggtgcagtctggggctgaggtgaagagccgtggggcctcagtagaggtctcctgcaggtcttcgtggactacagtcttaccgaccggtacctacgtattagtgcacgtgggtgaccgacgacggccccgtggacgaagggtctggaggtggagtgggacgataccgaacctagtagtggcgacaacaactntacgactacgagtagttggaggcgagggtcatcagtcgacgaggacacgcactacgacncacncgacctagacgtggacgctaggcgacggngacgtgaactagtcgacggaacgaccgggtaccgggtacgttagttaccgttacggtggttggaccgtaaggtaacggtaaggggttaaagggtnttagggtacgttaacggtcgttaacccgg

SEQ ID NO: 17612 - DNA, 608 bp, Homo sapiens
  misc_feature: GYAE6OF02IMU7C.11.63.F08.1.454.CMB.1.raw
tcagcgagagataccacgaccggtgctcgatttagcgatcgtataagggggcatcacccagcaaccacatctgtcctctagagaatcccctgagagctccgttcctcaccatggactggacctggaggatcctcttctggtgcagcagccacaggacgccccactcccgaggtcgctagtttggtgcagtcgtgggctggaggtgaagagccgtgggccctgagtgaaggttcctccgtgaccgtaaggtcttcgaggactacgagtcttccaccggtctaactatagtgctacgtgggtgacacgcggccccgttggaccgagggtctaggagttgggatgggacgctaccaaaccttaggtcgtacggtgacctaaagaacctgtacgcacgagtaagtttggacggcgagggtcatctagtcgacgtaggacacggtacctagtcacgtcgaccacgtacctaacgacgttggacgtcctagacgtccgaggtactaggtacctcgttaccgtacggaacgtaccgtacggtcccggttattaccgttagttacgtggaccctagaacgttaggaaacgggttgtagtggtacgtacgttaaccg

SEQ ID NO: 17613 - DNA, 637 bp, Homo sapiens
  misc_feature: GYAE6OF02G7X4A.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtcgtggggctgaggtgaagagccgtggggcctcgagtgaaggtctcctgcaaggcttcgtggatacagcttcgaccggctactatatgctacgtgggtcgcgacgacggccccgtaggaaccgaagggtcttggaggtggagtagggacggataccgaaccttaagtaggtgggtacgacaactaaactagtacgacaacgtaaggtaagtttagggacggggtacgtacgggttacacgtacgacgtacggaaccggtaaggggacctaaccggtccaagtaccgacgaccaaccgacggtacctacgagtggacgtcgtaggacgtcgaacggtcgtacgaccgtacgtcgtacggaaccgaccgtacgggtacgttaggttacgttacggtggtacggtacgaagtaaggtaacgggtaagggttcttacgggtagtacgtaaccgg

SEQ ID NO: 17614 - DNA, 766 bp, Homo sapiens
  misc_feature: GYAE6OF02IQ0SF.11.63.F08.1.454.CMB.1.raw
  modified_base (582)..(582): a, c, t, g, unknown or other
  misc_feature (582)..(582): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcgttggtggcagcagccacaggacgcccactcccaggtcgactaggttcgggtgctaggtccggtggggtctggagggtgaaaggacggtccggtcggggtcctcgaggtggaacggttcctccgtgacgtaacgggtctttccgtaggtactaccgtaggtccttaccgaccggtacttaacgtacgtacgtacgccgtaacggttcgggtacgaccggtaacccgacgggccccgttagggaaccggtaacgggttccgttaggtaagggtacggggtaacggtacggggaaccgtaacgtacccgtaaaccgttaacggtagggtagggttaccgaaccaaacgtaaacgtggtacgaacgtaacgtaagggttacgtttaggggacggtacggtagggtactacgtacgtacgtacggacggtacgggtactaccgtacgtntaacgacggactaccgactaccgtacgtacggacggtctacggtagaccggacgtacgtacgacgacgtcgttaccgacggaccgaacggtccggtacggttagtaaccggtcgtacggttacggacgttaagggacggttaagggtaagggtttactagggtaacggttactacggttaaccg

SEQ ID NO: 17615 - DNA, 829 bp, Homo sapiens
  misc_feature: GYAE6OF02GGK7E.11.63.F08.1.454.CMB.1.raw
  modified_base (670)..(670): a, c, t, g, unknown or other
  misc_feature (670)..(670): n is a, c, g, or t
tcagcgagagataccacgaccggtgctcgatttagcgatcgtataagggggagcagtcacccagcaaccacatctgtcctctagagaatcccctgagagctccgttcctcaccatggactggacctggaggatcctcttcgttggtcggcagcagccacaggacgcccacctcccaggtcgcaggttggtgcgtagtcgtggggctaggacggtgaagaacgtccgtagggggtcccttacgaagttcggaacgggtccttaccgtgacgtaaacgggtcttaccgtagggtaacttacgacggtccttaccgtaccggcttaacgtacttaagtcgacacgtggggtcgacggtacgaccgggtccccctgggaaaccgtacggggtcgtttacggaacggtttacggggacggtttaggggaaccggtaacgttaccccgtaaaacccgtaacgggttacgggttaggggtaaccggtacgtaaaccgaaaaccgtttggttaacggaccctaaaggggttacggttaaacgggttttacgggggaaccggggtacgttaacgggggttaaccctacggtttaaccggtaaagtttaccgggaaccggttaaccgggggaaccccttaacgaacccggttaaacgtacggaaccgtcggtaaacccgngttaaacccctaggtacgtacggtacggtcttaacgggcgtacggaccgtacgtagaaacctttcggaccgttcgaacgaacggttccccgagttaaccgttcgttacggtatcggaacgtcgaaggtaacggtaacgtggttagtacggattaaccgg

SEQ ID NO: 17616 - DNA, 726 bp, Homo sapiens
  misc_feature: GYAE6OF02IJC8Z.11.63.F08.1.454.CMB.1.raw
  modified_base (488)..(488): a, c, t, g, unknown or other
  misc_feature (488)..(488): n is a, c, g, or t
  modified_base (590)..(590): a, c, t, g, unknown or other
  misc_feature (590)..(590): n is a, c, g, or t
  modified_base (672)..(672): a, c, t, g, unknown or other
  misc_feature (672)..(672): n is a, c, g, or t
tcagcgagagataccacgaccggtgctcgatttagcgatcgtataagggggcatcacccagcaaccacatctgtcctctagagaatcccctgagagctccgttcctcaccatggactggacctggaggatcctcttcgtggtggcagcagccacagggacgcccacctcccaggtcgctacgttggtcgctagtcgtggggctggaggtaggaacgaaggtccgtggggccctacgaggttaggaacggttcctcaggccgtaaggtccttcgtcggatacacggtcttaccgaccggtctaacttatactcgactacggtgggtcgccgtacggaccgggtcccgtagggaaccgtaacgggtcttagggacgggtgggtaacggtacgggaccgggtattaacccgaaaccgtttaaggtggtacggttagggaacctaaactaagtacgtctaccgaacgtaagggttaacgtttgggaccgggngttaacggggttacaacgtacgtacgtaacggtacggaacgggaccaccgtaccgtacgtacgaacgaccgtacgacgtacctacgtacgtcggaccgtcgnggacgacgacgtcgtaccgactactcgtaccgaaccgccggtaacccggttcgttacggtttacgtcggttacgacgggtanaagggtaaccggtaaggtaacgggttgttcggtaaggtacggttaaccgtaacg

SEQ ID NO: 17617 - DNA, 664 bp, Homo sapiens
  misc_feature: GYAE6OF02G5HZU.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcaggtttggtcgcagtcgtggggctggaggtgaagaagtccgtgggcctgagtggaacggtctcctgacaaggtccttacgtggacttacgagtccttaccgacccggtacttactataacgtcgaccgtacgttgggtcggaccggacgaaccgggtcccccgtagggaccgaaggggtccgtttggacgggttgggaacggtggggaaccgtactacccgtaaaccctaggttacggtgggtcgacaacgtaactagtcgacaacgtaaggtaggttaggaggtacgacgggtacagttaccagtacggaccgacgggactccgtacctacgcgacgacctacgaccgtaccgtatacgtggacgttcgagacgacggagtacgtacgacgtacgttacgacgtaacgggaccgtacgggctttacggtactttacggtcggtagacggagtaaggtaacggtaaggttagtcggttagagttaccg

SEQ ID NO: 17618 - DNA, 703 bp, Homo sapiens
  misc_feature: GYAE6OF02HWN3J.11.63.F08.1.454.CMB.1.raw
  modified_base (199)..(199): a, c, t, g, unknown or other
  misc_feature (199)..(199): n is a, c, g, or t
  modified_base (435)..(435): a, c, t, g, unknown or other
  misc_feature (435)..(435): n is a, c, g, or t
tcagcgagagataccacgaccggtgctcgatttagcgatcgtataagggggagcatcacccagcaaccacatctgtcctctagagaatcccctgagagcctccgttccctcaccatggactggacctggaggatcctcttcgttggtggcagcagccacgaggacgcccacctcccgaggtgcaggttggtgtagtcgngggctggaggtgaagagccgtgggcctgagtgaaggtctccgtgacgaaggtcttcgtaggactacgagtccgttaccgaaccggtcttaacgtatagtcgacgtaccggtgggtccgacgaaccgtaccggtcccccggtaagggaaccggtaacgggtcttagggtacggtagacgggtagggaaccgtaaccgtacctaaaaccgtaagtaggtcggtacgactaacgaactntagacaacgtagtaacgttggagggtacgtagggtcaagttacgaagtaccggaacgtacggaacctccgtaaccacgtacgacgaccaaccgcgtaccaacgtacgtagtacgcgtaaggcgaccggtagtccgttagaaccgtcgtaccgtacggaaccggtaaccggcggttaccgttaacgttaccgtaacggttcgacggaagggtaacgtaaaggtaagggtaacgggttagttacgggtaacgtacgttaacgtaacccgg

SEQ ID NO: 17619 - DNA, 575 bp, Homo sapiens
  misc_feature: GYAE6OF02GK7QB.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgctacgtgggtgcgacacggcccctggacgaagggcttggagtggatgggacggatccaacctaagtacgtggtgacaactaaactatgacaacaggtaagttggacgggacgtagggtcagtcatcgaccgagggacacgtaccagtaccgagtccaacgacgtacctacgagtagggagctaggacggcgaggtcgtacgacgtacgtcgagaaccgaccgtaccggtccgttcgtaacttacgtggtacgtacggaaggacggtaaggttaaagggggtatttacggtaggtagttaaccgg

SEQ ID NO: 17620 - DNA, 759 bp, Homo sapiens
  misc_feature: GYAE6OF02IXZTL.11.63.F08.1.454.CMB.1.raw
  modified_base (235)..(235): a, c, t, g, unknown or other
  misc_feature (235)..(235): n is a, c, g, or t
tcagcgagagataccacgaccggtgctcgatttagcgatcgtataagggggcatcacccagcaaccacatctgtcctctagagaatcccctgagagctccgttcctcaccatggactggacctggagatcctcttcttggtggcagcagccacaggacgcccacctcccgaggtgcagttggtgcgagtcgtgggctgaggtagaagagccgtgggcctcgagtagacgtctccngacgaaggtcttcgtaggactacagtccttcgacccggtctacttatacgtgacgtacgtgggtgccgacgaccggtccccgtaggacggaagggtcttggaggtggagacgggacgactaccgtaaaccctagtacggtggtacgaactaacgtaaacctagtacgaaccgtaagtaaggtaacggttttacgggaaggggtaaccggtacgggtaccgtacgttaccggacgttaaccggaaaccgggaaccgggtaaccgtacccgtacccgaaaccgttaccgaaccgacccggaaactacggtaacccttaacgaggtaacgggacgtacgttacgggacggacccggtaacggtaccggttaacgacgtttaccgttaccggtaacggtaacccggaccgtaacccggggttaccgtttaccggtttacgtttaccggtaggtaccgggaagtaacgggtaaggtaacgggttaaggggttaccgttacgggtaacgttacggtaaccgttaacccgg

SEQ ID NO: 17621 - DNA, 989 bp, Homo sapiens
  misc_feature: GYAE6OF02F40ZD.11.63.F08.1.454.CMB.1.raw
tcagcgagagataccacgaccggtgctcgatttagcgatcgtataaggggcatcacccagcaaccacatctgtcctctagagaatcccctagagagctccgttcctcaccatgactggaccgtggagatcctcttctgggtggcacgcacgccaacgaggtacgccctaccgtcccgaagggttcgacgtagggtttggtcgaccgtaaggttcggtcggggtactgggaacgggttaggaaaacggaaccgtcccgggttcgggggaccccttacgaagggttacggtaaacgggttccgtacccgtaggaaccgtaacggtccgttttaccgtagggtaacttaacccgtacggtacccgtttaccggacccgggttacttaaacgtttaacgtaacggttccgaccggtacggttacggggtaccgacgtaacccggaccccggtacccggttagggaaaccggtaacgggttacttaacggggtacgggttacggggtaacgggtttaccgggggaaacgtaacccggttaaaaccccgtaaaccccggttaaaaggtttaccgggggtacgggttaaccggtaaacccgtaaaacccgttaaacggttacgtacgtaaacccggtaagtaaacgggttttaaggttacggggaaacgggttacggaccgggttactaacgtaccggtaagtaccggaacgggtaacggaaaccgtaccgttacggacgtaccgtaacgacccggtaacacccggttaccgtaacgtcgggttaaccgggacggttcgtaacgggaaaccgtccgggtacggtacctaacggtacctttaacggaccggtacgaacccggggttaaccgcccgggttacggtttaactacgggttaccggttacggttaccgggaacggttaaacggtaacgggtttaacgaagggggtttaaacccgtcggtttaaacggggtacctttaaccggttaaccggg

SEQ ID NO: 17622 - DNA, 631 bp, Homo sapiens
  misc_feature: GYAE6OF02GS4E1.11.63.F08.1.454.CMB.1.raw
tcagcgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagccccactcccaggtgcagttggtgcagtctgggctgaggtgaagagtccgtgggcctcgagtgaacggtctcctgcgaaggtcttcgtggatacgacgtcgttcaccggcttacgtatgtgcacgttggtcgcgacaccggcccgtaggaacgagggtcgtggaggtcggagtcgggacgtatacctaaccgtagtagtggtcgactaacaagtctagacgaacgtaagtacggtttaggaggggtacctagggtacctagttaccgagtacgaccgtaagggacccacggtcctaacgtcgacgtccgaactccgtacctaacgagtccgggactcgtagacggtccgtacggactacggatacgtcgtacgaaccgtccggaccggtccggttacgttaacgttacggtcgtaggtaccggaaggttaggaaacgggttaagggagttacggtagtaacgtttaacgg

SEQ ID NO: 17623 - DNA, 563 bp, Homo sapiens
  misc_feature: GYAE6OF02ITFSE.33.17.B06.1.454.CMB.1.raw
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagtacacacactcacgaccggtgctcgatttagtcgatagtgaagggtaaagggggtaggtcagtctccaagtcgaggacacagcagtggacatggacgggtcccgctcagctcctggggctcctgctcctctggctccgaggtgccagatgtgacgtccagatgacccagtcctccatccctccctgtccttcatctgtaggagacagagtcacatcacttgccggcagtgagagcatagaacctattgaattggtaatcaagcagacacgaggaaacgaccccaaatccagacctctctcgccgactactccgaatttacacgtagtcggggtaccctagtcggtaggttacagtggactagtgatcgngacagtnttcgactctactaactataacgcaacgtctcgaactagatagtttgaatgttacttcgtagtactaactagtacttacgtaacgtaaccttactacgtttacgacgtaacgggacctaagtcgtacgtacgacttacgaacgtacgtaagtggacgtatacgactacgagtcttcgtcttacg

SEQ ID NO: 17624 - DNA, 844 bp, Homo sapiens
  misc_feature: GYAE6OF02FZ9MW.33.17.B06.1.454.CMB.1.raw
tcagtacacacactcacgaccggtgctcgatttagtcgatagtgaaagggaaagggggagtcagtctcagtcaggacacagcatggacatgagggtccccgctcagctccgtgggctcctgctcctctggcctccggaggtcgaccagatggtcgaccgtccagatcgacccagtcctccatccctcctgttcttcattcgtggtaggagacagacgtccacctagtcctacgttcggccggactaagtgaacgtacgacctaagtaacgtaacctttagtttaggtaacgtttaggtaactacgacggacgaacgaacggaaccggtaacgggaaaccccgaaccccctaaaccgtcccgtacggtaaccttccgtcccgtcggacctacgtaccttaccggtaactttaacgaaccgtaacggttccggggttaccctaacgggttccggttaacggttacgtacggggtacggtacggttaagggttacggtacggttacggaacgggtaacgttaacgtttaccgttaccgtaccttccgtaacccgtaaccgttaaacgtaacggtaaccgtacggttaccgtaacggtaaccggtaaggttaaacggtttaacggtttaacggtaacgttaaccgtttacgtttaccgttacgttaacctaacggttaaccttaaacgtttaaccgttaacccggttaaccgtttaccgtttaacgttacccggaaccggtaccgggtaaacgaacgtacgtacggtacgtaacgtacgaacgtaccggtacgtacgggttacgtaccgtacggtacctacgttaacctcgtttacgttaccttaccg

SEQ ID NO: 17625 - DNA, 526 bp, Homo sapiens
  misc_feature: GYAE6OF01A4YAZ.3.3.A03.1.454.CMB.1.raw
tcagagacgcactccacgaccggtgctcgatttagagagcgtcacagaggagaaggggctagggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagccgcccctcagggactccctgagcgattctctggctccaactctagggaacacagccactctacgaccatcacgccgggacccaggctagtggatgaggctgactatactgtcaggcgtgggacaggcggcgcgactcccaatagttccgggacgggtagggaccgaacggcctcggacccggttaccgtacggtaccgacggcccgaaaggtcccg

SEQ ID NO: 17626 - DNA, 505 bp, Homo sapiens
  misc_feature: GYAE6OF01AC74I.3.3.A03.1.454.CMB.1.raw
  modified_base (303)..(303): a, c, t, g, unknown or other
  misc_feature (303)..(303): n is a, c, g, or t
  modified_base (499)..(499): a, c, t, g, unknown or other
  misc_feature (499)..(499): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacngggccactggcatcccagccaggttcagtggcagtgggtctgggacagacttcactctcaccatcagtagcctagagcctgaagattttgctagtctattatgtcacagcgtgcacgtggccctcgtggacgttcggaccgaagggaccgaaggtgaaacgtcgaaccgaactgtcggctgcaccatctgtcttcnttcccg

SEQ ID NO: 17627 - DNA, 508 bp, Homo sapiens
  misc_feature: GYAE6OF01CB6OG.3.3.A03.1.454.CMB.1.raw
  modified_base (413)..(413): a, c, t, g, unknown or other
  misc_feature (413)..(413): n is a, c, g, or t
  modified_base (503)..(503): a, c, t, g, unknown or other
  misc_feature (503)..(503): n is a, c, g, or t
tcagagacgcactccacgaccggtgctcgatttagagagcgtcacaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagtattttgctagtctattattgtcaacngcgtggcaactcggccctgtcggacgttcggacgacgggaccgaaggtaggaaagtcaaccggaactgtggctgcaccactctgtcttcnttccg

SEQ ID NO: 17628 - DNA, 511 bp, Homo sapiens
  misc_feature: GYAE6OF01B91WK.3.3.A03.1.454.CMB.1.raw
  modified_base (507)..(508): a, c, t, g, unknown or other
  misc_feature (507)..(508): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccatggcatcccagccaggttcagtggcagtgggtctgggacagacttcactctcaccatcagtagcctagagcctgaagtattttgctagtcttatttattgtacaacagcgtgcaacgtcggccctcgtggacgttcggacgaacgggaccaaggtaggaaatacgaaccgtaacgtgtaggctgcactatctgtcttnntcc

SEQ ID NO: 17629 - DNA, 581 bp, Homo sapiens
  misc_feature: GYAE6OF01ENQJ4.3.3.A03.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggcctcccaggctcctcatctatgatgcatccaacngggccacgtggcactcccagccaggttcagtggcaggtgggtctgggacaggtacttcactctcacctatcagtacgcctagacgcctagaagtatttgctagttcttatttattcgtacaacgagtcggtaggacctaacgtcggtcccgtcggtcgggtaccggtttccgggacccggtaacggggaccgaaagggtacggaaaacgtaccgaaacccggtaacgttaggtacggcgtacggaccacccgtacttctagttccttcgtcttccccg

SEQ ID NO: 17630 - DNA, 524 bp, Homo sapiens
  misc_feature: GYAE6OF01AFIJN.3.3.A03.1.454.CMB.1.raw
  modified_base (304)..(304): a, c, t, g, unknown or other
  misc_feature (304)..(304): n is a, c, g, or t
  modified_base (517)..(517): a, c, t, g, unknown or other
  misc_feature (517)..(517): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacgngggccactggcactcccagccaggttcagtcggcaggtgggtctgggacaggacttcactctcaccatcagtacgcctagcgcctagaagtatttgactagtcttattattgtacaactagcgtgcaacgtcggccctggtgacgttcgaccgaagggaccaagggtcgaaactcgaaccggactggtacggctcgacactatctagtcttcncttcccg

SEQ ID NO: 17631 - DNA, 542 bp, Homo sapiens
  misc_feature: GYAE6OF01B8E4C.3.3.A03.1.454.CMB.1.raw
  modified_base (196)..(196): a, c, t, g, unknown or other
  misc_feature (196)..(196): n is a, c, g, or t
  modified_base (419)..(419): a, c, t, g, unknown or other
  misc_feature (419)..(419): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaaacagggccactggcatcccagccaggttcagtggcaggtgggtctgggacagacttcactctcaccatcagtacgcctagacgcctagaagtatttgctagtctattattgtacaacngtcgtggcaacgtcggcctcgtggtacgttcggccgaacgggaccgtaagggtacggaaactaccgaaaccggtaacgttggtacgggctcggaccaccgtactctgttccttcgcgttcccg

SEQ ID NO: 17632 - DNA, 528 bp, Homo sapiens
  misc_feature: GYAE6OF01EBMYB.3.3.A03.1.454.CMB.1.raw
  modified_base (196)..(196): a, c, t, g, unknown or other
  misc_feature (196)..(196): n is a, c, g, or t
  modified_base (521)..(521): a, c, t, g, unknown or other
  misc_feature (521)..(521): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaacagggccactggcatcccagccaggtcagtgcagtggtctgggacagacttcactctcaccatcagtacgcctagacgcctgaagtatttgctagtcttatttattgtacaacagcgtgacaacgtcggccctcggtcggacgttcggaccgaacgggaccgaaggtacggaaacgtacgaaccgaacgtggtacggtctgccacctactctgttcttcncttcccg

SEQ ID NO: 17633 - DNA, 573 bp, Homo sapiens
  misc_feature: GYAE6OF01C8ZSM.3.3.A03.1.454.CMB.1.raw
  modified_base (197)..(197): a, c, t, g, unknown or other
  misc_feature (197)..(197): n is a, c, g, or t
  modified_base (379)..(379): a, c, t, g, unknown or other
  misc_feature (379)..(379): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtatcaacagaacctggccaggctcccaggctcctcatctatgatgcatccaaacgacgggccacgtcggacactccccagccaggttccaggtcggctaggtggggtctggggacaggacttcacttccncaccatcagtacgccagacgcctagaagttattttgactagttacttatttattgtacaactgcgtgacaacgtcggcccgtcggtcggtacgttccggaccgagggaccgtaagggtacgaaacgtaccgaaaccggtaacgtggtacggctcgaccaaccgtacttacgttgttaccttctacgtttccccg

SEQ ID NO: 17634 - DNA, 680 bp, Homo sapiens
  misc_feature: GYAE6OF01DUTIK.3.3.A03.1.454.CMB.1.raw
  modified_base (289)..(289): a, c, t, g, unknown or other
  misc_feature (289)..(289): n is a, c, g, or t
tcagagacgcactccacgaccggtgctcgatttagagagcgtcacagggggaggaactgctcagttaggacccagagggaaccatggaagtccccagctcagtcttctcttcctcctgctactctggctcccagataccgaccggagaaattgtgttgacacagtctccagccaccctgtctttgtctccgaggggaaatcgccaccctctcctgcagggccagtcagagtgttagcagctacgttagcctggtatcaacagaaacctggccaggctccaggcctcctnatctatgatgcatccaacgcggccactggcactcccagccaggttcaggtcggctaggtcgggtctagggactagacttcgacctctacgacctatcgaagtacgaccttagacgtaccgttagaacgttattttagacctagttacttaatttaacgttcgtaactaacgtacggtacggttacggacgtaaaccgttcggggtacccctttcggggtacggtacccgggtttaccgggaaccccggtaaacggggtaacccgtaaagggtaccggtaaaaccgtaacccgtaaaccccgggtaaacgttcgggttacgggacccttaccgggaccctaaccccgttacgttaccctttacggttccctttccgtacccgtttacccccg

SEQ ID NO: 17635 - DNA, 583 bp, Homo sapiens
  misc_feature: GYAE6OF01BVPJY.3.3.A03.1.454.CMB.1.raw
  modified_base (195)..(195): a, c, t, g, unknown or other
  misc_feature (195)..(195): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (453)..(453): a, c, t, g, unknown or other
  misc_feature (453)..(453): n is a, c, g, or t
  modified_base (569)..(569): a, c, t, g, unknown or other
  misc_feature (569)..(569): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaattgtgttgacacagtctccagccacctgtctttgtctccgaggggaaangccaccctctcctgcagggccagtcagagtgttagcagctacttagcctggtatcaacagaaacctggaccacggctacccgaggctcctcatctatgatgcataccaacgcgggccacgtcggcctaactcccacgcctaggtttcgaggttcggacgtagggttgggtactggggacagtacttcgactctacacgatcagtcncctagacgtcctagaacgtntttcgactagttcttaatttatcgtacaacgngtcgtggacaacgtcggtccctcgggtaggtaccggttcggacgaacgggaccgaagggtacgaaacttaccgaaccgtacgtgggcggtctacgccaactcgttactccccgttnttcgtaccttcccg

SEQ ID NO: 17636 - DNA, 590 bp, Homo sapiens
  misc_feature: GYAE6OF01A4AVG.3.3.A03.1.454.CMB.1.raw
  modified_base (305)..(305): a, c, t, g, unknown or other
  misc_feature (305)..(305): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggcctcctcatctatgatgcatccaacgngggcccacgtggcactccccagccagggttcagtcggcaggtgggtctgggacaggacttcactctcaccatcagtacgcctagacgtcctagaagtattttcgctagttcttatttacttgtacaacagtcgtggacaacgtcggccctcggtacggtacggtttcgggacccgaacggggtaaccgaaggggtacggaaaacgtaccgaaacccggtaacgtacgggtacgggtccgttcggaccaacccgtactccgttacgttcctttcgtactttccccg

SEQ ID NO: 17637 - DNA, 634 bp, Homo sapiens
  misc_feature: GYAE6OF01C7NBH.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtatcaacagaaacctggccaggcctcccaggcctcctcatctatgatgcactaccaacgacgggcccaacgtgggccactccccagccgtagggttcaggttcggacgtagggttcggggtcgtaggggaaccaggtactttccgacttccgtaccaccgatccgaagtacgacctagacgtccgtagaaacgttattttgactagttacttaatttattcgtacaacgtagtcggtaggtaccgaacgtcggtccccgttacgggtacggtaccggttccggaccgaacgggaccgaagggtaggaaacctaccgaaaccggtaacgtggtacggtctacgacctaaccgtacgttacttaggttttctacgttcccgttccccg

SEQ ID NO: 17638 - DNA, 814 bp, Homo sapiens
  misc_feature: GYAE6OF01DVYD4.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagtctacttagcctaggtatacaaacagaaacctggaccaaggcctccgaggcctcctcactctaatgaatgacactcccgaaacgcgggacctaacgtcggacctactccccgaaggtcccgtaagggtttccaaggttcggacctagggttcggggtctacggggactacggtaccttcgaccttcctacgaaccctagttaccgaacggttacgacccgtaacggacgtacccgttaagggtaaacgttacgtttttacggaccgttaacgttaccgtttaagtttaacgtttacggtaacctaaccgtaacgggttacggtacgggtaccgtaaaccggtttccggggacccccgtttacggggttaccggggttaacccggtttaccggggtaaccccgggtaaaacgggggtaaaccccggtaaaagggggttaacgggtaaaaacccgttaacccggtaaaacccgggtaaaccggttagggttaccgggacccggttacggtaaccccgtaacccgttaacggttaccgtttaccggtttacctttacccgtaacggtttttacccccccgg

SEQ ID NO: 17639 - DNA, 739 bp, Homo sapiens
  misc_feature: GYAE6OF01DC114.3.3.A03.1.454.CMB.1.raw
  modified_base (198)..(198): a, c, t, g, unknown or other
  misc_feature (198)..(198): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgctccgaaggggaaagngcccaccctctcctgcagggccagtcagagtgttagcagctacttagcctaggtatcaacaagaaacctggaccaggcctcccgaggcctcctcatctatgatgcactaccaacgacgggcccaacgtcggaccactaccccgacggccctaagggttcaacggttcggaccgtaggggttcgggggtcgttagggggaacctaaggtaacctttccgacctttccttacccaacccgtattaccgtaaggttaacgttaccctaaccgtaaccgttagtaaacgttacgtttttacgaaccgttaaactttaccgttaacgttacgtaaccgtaaacgtaacgtaacgttttaaccgaaccctttaacccccgttcccgtacccttaccgttaacccggttttaccggggaccgggtaacggggaacccggtaaggggttacgggaacgtaacgtaacgtaaaaccgtacgtaggtacggtcgtacggtaccaaccctagttaccgttcgttacttaccgtacttcccgttcccgtaccg

SEQ ID NO: 17640 - DNA, 596 bp, Homo sapiens
  misc_feature: GYAE6OF01AVWE6.3.3.A03.1.454.CMB.1.raw
  modified_base (282)..(282): a, c, t, g, unknown or other
  misc_feature (282)..(282): n is a, c, g, or t
  modified_base (342)..(342): a, c, t, g, unknown or other
  misc_feature (342)..(342): n is a, c, g, or t
tcagagacgcactccacgaccggtgctcgatttagagagcgtcacagggggagggaactgctcagttaggacccagagggaaccatggaagccccagctcagcttctcttcctcctgctactctggctcccagataccaccggagaaattgtgttgacacagtctccagccaccctgtcttgtctccagggaagagccaccctctcctgcagggccagtcagagtgttagcagctacttagcctggtatcaacagaaacctggccaggctcccaggctcctnatctatgatgcatccaacgaggccatggcactcccagccaggttcagtggcaggtggtcngggacagacttcactctcactatcgagtacgcctagacgccgtagaagtagtttcgactagttcttatttattcgtactaacgtagtacgttcgggactaacgtcggtacccgttcggtcggtaccggtttcggaccgaaacgggtaccgaagggttacggaaaacgtaacccgtaaaccgggtaaaccgttgggtacggtccgtcggtaacccgaccgtaacttcgttacgttcctttaccgacgttaccccg

SEQ ID NO: 17641 - DNA, 621 bp, Homo sapiens
  misc_feature: GYAE6OF01CD9PS.3.3.A03.1.454.CMB.1.raw
  modified_base (196)..(196): a, c, t, g, unknown or other
  misc_feature (196)..(196): n is a, c, g, or t
  modified_base (404)..(404): a, c, t, g, unknown or other
  misc_feature (404)..(404): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggaccaggcctcccgaggctcctcatctatgatgcatccaacgagggccactggcactcccagcctaggttcaggtggctaggtgggtctagggacaggtacttcactctcaccatcagtacgcctagcgtacctagaattntttgacgtagttacttatttattgtacgtaacacggtcgtacgggactaaccgtcgggtccccgttacgggtcggtacccgggtttccgggaacccggtaacggggtaacccgtaaaggggtaacggtaaaccgtaccgaaaacccggtaacgttcgggtacggtcgtacgtaccctaaccgtacgttcgttacgttccttccgtacgtttcccccg

SEQ ID NO: 17642 - DNA, 600 bp, Homo sapiens
  misc_feature: GYAE6OF01AR2OI.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacgagggcccactggcactccccagccaggttccaggtcggctaggtgggtctgggacagacttcactctcaccatcagtagcctagacgccgtagaagtatttgctagtcttatttattgtacaacgtagtcgtggactaaccgtcggccccgttcggtacgggtaccggttccgggaccgaacggggaacccgtaaggggttacggaaaacgttaccgaaacccggtacgttacgggtacggtccgtacgacccgaacccgtacttccgttacgtcctttaccgtaccgtttaccccg

SEQ ID NO: 17643 - DNA, 700 bp, Homo sapiens
  misc_feature: GYAE6OF01B64RK.3.3.A03.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccgganaaattgtgttgacacagtctccagccaccctgttctttgtctccgaaggggaaancgccaccctctcctgcagggccagtcagagtgttagcagctacttagcctggtatacaacaagaaaccgtggccaggcctaccccgaggcctacctcatacctaatgtaatcgaccaatacccaaacgagggtacccaacggtcggcctaactacccccgaggcccgtaagggttccaaggtcggccgtaagggttggggttaccgtagggggaacctaagggttaacctttacaaccttctaccaaccctaatccgtaaggttacgacccgttaaggacgtacccgttaggtaaaggtattttacgacctaagttacttaatttattagtacaagtacgtcgtacggacaaccggttcggcccgttacggtacggtacggttaccgggaccggtaacgggtaaccgtaaaggtaacggtaaacgtaaccgaaaccggtaacgttaggaggttacgtacgaccaacccgtacgtactacgtttccgttactcgttaccccg

SEQ ID NO: 17644 - DNA, 539 bp, Homo sapiens
  misc_feature: GYAE6OF01ELAW4.3.3.A03.1.454.CMB.1.raw
  modified_base (196)..(196): a, c, t, g, unknown or other
  misc_feature (196)..(196): n is a, c, g, or t
  modified_base (531)..(531): a, c, t, g, unknown or other
  misc_feature (531)..(531): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggcctcccaggctcctcatctatgatgcatccaacagggccacgtggcatcccagccaggttcagtgcaggtggtctgggacagcttcactctcacatcagtacgcctagacgctagaagtatttgactagttctatttattgtacaagagtcgtcgacaacgtcggcccttgggtcggtaccgttcggaccgaacgggaccgaagggtacggaaactaccgaacgtaacgtggtaggctagccaccgtatcttgttccttcncttccccg

SEQ ID NO: 17645 - DNA, 696 bp, Homo sapiens
  misc_feature: GYAE6OF01AMYVW.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtatcaacagaaacctggccaggcctcccgaggcctcctcatctatgatgcataccaacgcgggaccacgtggccacgtcccagccgaggttccaggtggacgaggttcgggtcgtaggggaactacggtactttaccacgtcctaccaacctataccaagttacgacctagtacgtaccgttaaggtaagttacgttttcgacgttacgttactttaagtttacttacgtacctaacgtacggtacggtacggacctaaaccggttccggaccccgttacgggttacgggtacccgggtttacccggaacccgggtaaacggggtaacccgtaaaggggttaacgggtaaaaccgtaaccggaaacccggtaacgttcgggtacgggtcctacggaccctaaccgtacgttaccgttacggtttacccttcgttaacccgtttccccg

SEQ ID NO: 17646 - DNA, 668 bp, Homo sapiens
  misc_feature: GYAE6OF01BVKDO.3.3.A03.1.454.CMB.1.raw
  modified_base (198)..(198): a, c, t, g, unknown or other
  misc_feature (198)..(198): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagngccaccctctcctgcagggccagtcagagtgttagcagctacttagcctggtatcaacagaaacctggccaggctcccaggctcctcatctatgatgcatacccaacgacgggaccacgtcggaccagtccccaggcccaggttccaggtcggcgtaggtgggtctggggacaggtacttcgactctacaccatcagtacgcgtacgagtcctaggtaagtagtttcgacgtaacgttctaatttacgttcgtactaacgtacggtccggtacggtaccgtaacgttccggtacccgttacgggttacgggtaccgtttaccggggaaccggtaaaccggggtaacccggtaaacggggttacggtaaaaccgtaccgtaaacccggtaacgttacgggtacgggtccgttacggacccgtaacccttaccggtttacgttaccgttccgttaccgtacgtttacccccg

SEQ ID NO: 17647 - DNA, 603 bp, Homo sapiens
  misc_feature: GYAE6OF01B70HV.3.3.A03.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctcagccacctgtctttgtctccgaggggaangccaccctntccngcagggccagtcagagtgtagcagctacttagcctaggtatacaacagaaacctggaccagggcctcccgaggtcctcctcatctatcgatgaccatcccaacgaggggccctaagtcggaccaacgtccccgagcccgtaaggttccaggtcggactaggggttggggtactacggggacacggtacttcactcgtacaccctatcgaagtacgccgtagacgtaccgtgtaacgttagttttcgactagttcttaacgtttattcgtaactaacgtacgcggtaggactaaccggtcgcccgtggtacggtacggttcggaccgacggaacgaaggtacgaataccgaaccgtacgtggaggctacgacactactctagttcttcgtcttcccg

SEQ ID NO: 17648 - DNA, 684 bp, Homo sapiens
  misc_feature: GYAE6OF01CJ48J.3.3.A03.1.454.CMB.1.raw
  modified_base (198)..(198): a, c, t, g, unknown or other
  misc_feature (198)..(198): n is a, c, g, or t
tcagagacgcactccacgaccggtgctcgatttagagagcgtcacaggggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgccaccctctcctgcgagggccagtcagagtgttagcagctacttagcctaggtatcaaacagaaacctggccaggcctcccaggcctcctcatctatgatgcactccaaacgcgggccagtcggcaactcccagccgtaggttcaggtggctaggtgggtctggggactaggtaccttcactctacacctataccgagtacgacctagacgaccttaggaagttacgttttgacttaggttacttaatttacgttagtactaaacgtaggtccggtaggtacctaacggtccggtaccccgttcgggtaccgggttaccggtttaccgggaacccggtaaacgggggtaacccgaaacggggttaacggaaaaccgttacccggaaaaccggtaaaccggttagggttacgggtcccggtaacgtaccccgtaacccgttaacgtttacccgttaggtttaacccttccgtacgttaccccccg

SEQ ID NO: 17649 - DNA, 945 bp, Homo sapiens
  misc_feature: GYAE6OF01BDTFL.3.3.A03.1.454.CMB.1.raw
  modified_base (203)..(203): a, c, t, g, unknown or other
  misc_feature (203)..(203): n is a, c, g, or t
  modified_base (346)..(346): a, c, t, g, unknown or other
  misc_feature (346)..(346): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagactaccaccggagaaattgtgttgacacagtcctccagcccacctgttctttgtcctaccgaaggggaaanacgccctaccctctccgtgaccgagggccaggtcagaggttgttagcagtccttacgttacgccgttaggtaaccagctaatttacgttcgttcggacccaggtcccttcccgaggtccctccgtacacttcgtatgggtacncctacgtacccccgaccccggggtacctaaccggttcgggttaacctccccgaggtcccgtaacgggtttaccgaagggttcggaccggtaacgggtttcgggggttacccgtacggggtaaccgtaggggtaacccttttaccgaaccctttcccgttaacccaaccctaacgttaccgaaacggccgtaaccggttccccggttaggggttaacccttacgttaacgggaaaccgtttaacccgttccggttaaggtaacccgttttagggtttttttaaaccttacgtcccgggttaactaacgggttacccttaaaaggttttaaacgtttaaaccgtttaacccgggttcgggggttaacccccgggtttacgggttaaaccccggggtttacccggggaaacccgggttaaaacggggtaacccggtaaaaggggttttaacccgggaaaaaccgtttaaccgaaaaaaccgggttcgttacgggtaccgggttacccggtaccaaccccggtaaacgtttaccctttaccgtttaccgggtttaaccctttacccgggtaaaccctttttcccccggtaacccccgtaaccg

SEQ ID NO: 17650 - DNA, 627 bp, Homo sapiens
  misc_feature: GYAE6OF01DYD3P.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangcccaccctctcctgcagggccagtcagagtgttagcagctacttagcctggtatcaacagaaacctggccaggctcccaggcctcctcatctatgatcgcatccaacgagggccacgtggcactcccagcctaggttcaggtcggctaggtcggggtctaggggaactaggtacctttcacttctaccaacctataccgaagtacgacccgtaggacgtcctaggtaagtagttttacgactacgttacttaatttacttgtactaacgtacgtcggtcggactaacgtcggtcccgttcggtacggtaccggttaccggaccgtaacggggaaccgtaagggtacggaaacgtaccgaaaccggtaacgtagggtacggtccgtacggtaccaaccgtacttccgttagttccttcgtacgttaccccg

SEQ ID NO: 17651 - DNA, 816 bp, Homo sapiens
  misc_feature: GYAE6OF01B72BM.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtgttagcagctacttagcctggtatcaacagaaacctggccaggcctcccgaggcctcctcatctatgatcgctactaccaacgacgggccacgtcggacactccccgagtcctaggttcaggtcggcgtagggttcggggtcgtaggggactacggtacctttccgaccttaccgtaccaacctacgttaccgtaacggtacggtacccgttaagggaccgtacccgttaagggtaaacggttacgtttttacggaccgttaacgtttcgtttaaacgttttaacttttacggttaaccgtaaaccgtacgggtacccgggttacgggtaacccgtaaccggttccgggtacccccgtttaccggggttaccggggttaacccgggttttacccggggaacccgggtaaaccgggggtaaaccccggtaaacgggggtttaaaccgggtaaaaaccgttaaaccccgggtaaaaccccggtaaacgggtttaccggggttacgggtacccgttaaccggggtaccctaacccggttacgtttacccgttacggttttacccctttaccgttaacccgtttccccccgg

SEQ ID NO: 17652 - DNA, 558 bp, Homo sapiens
  misc_feature: GYAE6OF01AW6K7.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgctatcccaacgagggcctaacgtcggaccactccccgaagtcccaagggtttcaggtggcgaggtggggtctggggacaggtacttcactctcaccgatcgagtacgcctagacgccttagaagtatttgactagtcttattattgtacaactagcgtgactaacgtcggcccgtgtcggcgttacggaccgaacgggaccaagggtgaaactaccgaaccgtacgtggtaggctgccactatccttagtccttcgtactcccg

SEQ ID NO: 17653 - DNA, 596 bp, Homo sapiens
  misc_feature: GYAE6OF01BOJ62.3.3.A03.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctctcctgcagggccagtcagagtgttagcagctactagcctggtatcaacagaaacctggccaggcctcccgaggcctcctcactctatgatgcatccaaagngggccagtggacatcccagccgtaggttcaggtgcgagtcgggtctgggacagtacttcactcgtacaccatcagtacgacctagacgtcctagtaacgtagtttcgactagttcttaatttagttacgtacaacgtagtcgtacggactaacgtcggtcccgtcgggtacggtaccggttaccggaccgtaacggggaaccgtaagggtacgtaaacgtaaccgaaaccggtaacgtaggtacggtcgtacggaccaaccgtactcgttacgtctttccgaacgttccccg

SEQ ID NO: 17654 - DNA, 549 bp, Homo sapiens
  misc_feature: GYAE6OF01BBBRI.3.3.A03.1.454.CMB.1.raw
  modified_base (196)..(196): a, c, t, g, unknown or other
  misc_feature (196)..(196): n is a, c, g, or t
  modified_base (543)..(543): a, c, t, g, unknown or other
  misc_feature (543)..(543): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaacgcgggccacgtggcactccccagccaggttcaggtggcagtggggtctgggacagtactcacctctcaccatcagtacgcctagacgcctagaagtagttttgacgtagtcttatttattgtacaactagcgtggctaacgtcggcccgttcgtcggtacgttcggaccgaacgggaccgaaggtaggaaacgtacgaaccgtacgtaggtcggtctcgacaccgtattctgttcttcgtnttcccg

SEQ ID NO: 17655 - DNA, 813 bp, Homo sapiens
  misc_feature: GYAE6OF01EN74Y.3.3.A03.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagactaccaccggagaattggtgttgacacagtctccagccacctgtcttgctccgagggaancgccacctctcctgcgaggccagtcaggtagtgtancagtctacttagcctaggtactacaaacgacgaacctcgggaccaggcctacccgaggtcctcctactatctagtgactgacctactaccgaacgtacgggaccaacggttcggacctaccgtaccccgacggtacccgtaagggttacgacgggttacggaccgttagggggttcggggttacggtaacgggggtaaccctaacgggtaccctttaccgtaacggttacccctaccgtaaacccgttacgtttaacccggtaacggtttaaccggtaccccggtttaaacgggtaacccgggttacccgtttaaaggggttaaacggttttaaaccgtttttcgaaccgttaacgtttaacctttaagttttaacgttaaccgttaaccgtaaacgtcgggttaccggtacgtacgtaaccggtttcgggtacccgttacgggttacgggtacccggttccgggtaacccggaacgggtaaccgtaaggggtaaaccgtaaacgtaaccggaaacccgttaggtaggccgtacgtaccgtaccgacgttactcgtttaccgtcctttcgtcgtttaacccccg

SEQ ID NO: 17656 - DNA, 628 bp, Homo sapiens
  misc_feature: GYAE6OF01CNY16.3.3.A03.1.454.CMB.1.raw
  modified_base (286)..(286): a, c, t, g, unknown or other
  misc_feature (286)..(286): n is a, c, g, or t
tcagagacgcactccacgaccggtgctcgatttagagagcgtcacagggggaggaactgctcagttaggacccagagggaaccatggaagcccagctcagcttctcttcctcctgctactctggctcccagataccaccggagaaattgtgttgacacagtctccagccaccctgtctttgtctccgaaggggaaagacgccaccctctcctgcagggccagtcagagtgttagcagctacttagcctggtatcaacagaaacctggccaggctcccaggctcctnatctaatgactgctataccaaacagggccaactggacactcccagcctagggttcaggtggcaggttgggacgtaggggacacggtacttcactcgtacaccatacagtacgcctaagacgtcctaggtaacgtattttacgactagtcttaatttagttacgtactaacgagtcggttacgactaacgttcggcccgttcgggtacgggtaaccgttcgggacccggtaaacgggaaccgtaaagggtacggaaaacgttaccgaaaccggtaacgttacgggtacgggccttaggacccacccgtaacttaccgtagttacccttacgtaacttccccgg

SEQ ID NO: 17657 - DNA, 707 bp, Homo sapiens
  misc_feature: GYAE6OF01D6R8C.3.3.A03.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagcccacccttgttctttcgtcctaccgaaggggaaanacgccctaccctctcctgcgagggccagtcagtagtgttacncagtctacgttacgccgttaggtactacaaacgaacgaaaccgtggacccgaacggcctacccgaggtccctcctactacttctagttgacttcgacctaaccgtacccgaaacggtaccgggaccctaccgtcggtaccctacctaccccgaacgtacccgtaggttaccgagggttcggacgtagggttcggggtaccggtagggaacctaggtacctttacgactcccgtactacctactacgtaagtccgacgtacggacgtccgtagtaagttcgtttgaccttaggtttcttaagtttacttacgtaccaacggtagtccggtagaccgtaccgtcggtccgttcggtaccggtacgtccgacgaacgggacgtaacggtagtaacgtaaccgaccggtaatcgggtactcgtacgaccacgtacttcgttattaccctttcgaccgtttccccg

SEQ ID NO: 17658 - DNA, 619 bp, Homo sapiens
  misc_feature: GYAE6OF01BQNLE.3.3.A03.1.454.CMB.1.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcgacgggccagtcaggagtgttagcagctacttagcctggtatcaacagaaacctggaccaggcctcccaggcctcctcatctatgatgcatccaacgacggccacgtcggcactcccagcctaggttcagtggcaggtcgggtcngggacagtactcactctacacctatcgaagtacgactaggacgtcctaggtaagttatttacggctacgttacttaatttagttctacaacgtagtcggtagacctacgtcggtacccgtcggttacggtaccggttcggacccggaacgggtaaccgtaacgggtacgaaaccgttaccgaaaccggtacggtaggtacgggtacctacggaccctaacccgtacgttcccgttacggtttccttcgtactttacccccgg

SEQ ID NO: 17659 - DNA, 545 bp, Homo sapiens
  misc_feature: GYAE6OF01BGHOD.3.3.A03.1.454.CMB.1.raw
  modified_base (197)..(197): a, c, t, g, unknown or other
  misc_feature (197)..(197): n is a, c, g, or t
  modified_base (418)..(418): a, c, t, g, unknown or other
  misc_feature (418)..(418): n is a, c, g, or t
  modified_base (529)..(529): a, c, t, g, unknown or other
  misc_feature (529)..(529): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccatctcctgcagggccagtcagactattagaagcaacttagcctggtaccagcagaaacctggccaggctcccaggctcctcatctatggtgcatcccaccgagggccacgtggtactcccgagccgaggttcaggtggcaggtgggtctggggacagtagttcactctcaccatcagcacgcctgcgagtcgtagtaagtgttttgcttactttntttctgtctagctagttataatacgtcgtccgtcgtcgggtacggttccgggaccggggtacgtagggtggagtagtacgaacgtacgtgtggcgtcgacactactcgttntcttctgttcctcccg

SEQ ID NO: 17660 - DNA, 678 bp, Homo sapiens
  misc_feature: GYAE6OF01DJ1EH.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagcccacctgttcttgtctccaggggaangccacctctcctgcagggccagtcagagtgttagcagctacttagcctggtatcaacacgaaacctggccaggcctcccgaggcctcctcacttctattgatcgacactaccaacgcgggccaacgtggcctactcccgacgtccgtaggttccaggtcggctagggtcgggtccgtaggggacaggtaccttccgacttcgactaaccctagtcaacggtacgtacctacgtacggtcccttaaggtaaacgtttgttttacgacgttacgtttacttagttttaacttcgtaacgtaaccgtaggtccggttaggaacctaaccggttccggtaccccgtttcgggtacgggtaccgtttccgggaacccgtaaggggaacccgtaaagggttaccggaaacctaccgtaaaccggtaacgttgggacggtccgtaccggactacccgacgtttcctagttcccgttctaccgtttccccg

SEQ ID NO: 17661 - DNA, 758 bp, Homo sapiens
  misc_feature: GYAE6OF01EKNE4.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgttctttgtctccgaaggggaaagacgcccaccctctcctgcgacgggccagtcagtagtgttagcagtcttacttagcctggtactacaacacgaacctggaccaggcctccgaggcctcctacatctatgatcgactactacccgaaacggcgggacccacggtcggacctaccgtccccgacgtccgtaaggttcaggtcggacgtaggttcggggtcgtagggactacgtaccttcacctctaccgactataccgagtacgtaccgtacggacgtaccgttaaggtaacgttacgttttacggacgttaacgtttacttttaagtttaactttacgtaaccgtaacgtacgggtaccggtacgggtaaccgtaaccggttcccgggttaccccggttaccgggttaccgggttaccgggttaccgggaacccggtaaaccgggggtaaccggtaaacggggttaacggtaaaccgtaaaccggtaaacccggttaaccggttacgggttacggtccgttaccggaacccttaaccgttacgttccggtttaacttcccgtttaccgtaccgtttccccg

SEQ ID NO: 17662 - DNA, 575 bp, Homo sapiens
  misc_feature: GYAE6OF01ANPMA.3.3.A03.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (401)..(401): a, c, t, g, unknown or other
  misc_feature (401)..(401): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtgttagcagctacttagcctggtatcaacagaaacctggccaggctccaggctcctcatctatgatgcatccaacgngggccacgtggcactccccagccctaggttcaggtcggcaggtgggtctgggacagacttcactctcaccatcagtacgccgtagacgtcctagaagtnttttgctagtcttattattcgtacaacgtacgcgtggactaacgtcggtcccgtcggtcggtaccggttccggaccgtaacggggaccgtaagggtacgtaaaacgtaccgaaaccggtacgtaggtcggtcgtacggaccgaccgtacgttctagttccgttcacgttccccg

SEQ ID NO: 17663 - DNA, 682 bp, Homo sapiens
  misc_feature: GYAE6OF01BBJF0.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaattgtgttgacacagtctccagccacctgtctttgtctccgaggggaaagacgccaccctctcctgcgacgggccagtcagtagtgttagcagcttacttagccttggtatacaacacgaaacctcggaccgacggcctcccgacggcctcctctactctatgatcgacactaccgaacgacggccacgtcggccacgtcccagccgtacggttcaggtcggacgtagggtcggggtcgtaggggaactacggtaccttccgaccgttctaccaaccgtacttaccgtaacggtacgtacccggtaaggacggtacccgttaagggtaaagtttacgttttaggacctttaagttacctttaatttacgttacgtaccgtaaacgtcggtcggtacggacctaaccggtccggtaccccgtagggttccgggtaccggttaccggaaccggtaacgggtaccgtaagggtacgaaactaccgaaacgtacgtggtacggcgccgaccacgtacttcgtacttcttacgtcttccccg

SEQ ID NO: 17664 - DNA, 910 bp, Homo sapiens
  misc_feature: GYAE6OF01EDZZ5.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagccttggtatcaacagaaacctggccaggctcccaggcctcctcatctatgatgacactccaacgacggggcccacgtcggcctactcccccgagtcccgtagggtttccaaggtcggaccgtagggtcggggttccgtagggggacctaagggtacccgttttcaacccgtttcctacccgtaaccctaagtttacccgaaacgggtttaaccggtaaccccgttaacgggtaccggtacccgtttaacgggttaaaacggtttaacggttttttacgggtaccgtttaacggtttaacccttttaaacggtttttaacgttttaccgtttaacccgtaaaccgttaacgggttacccgggtttaaccgggacccgttaaaacccggttccggggttaccccccggtttaccggggtttacccgggggttaacccgggggtttttacccgggggaacccccgggttaaaaccgggggggtaaacccccgggtaaaagggggttaaccggggtaaaaaccggttaacccggtaaaaaccccgggttaaacccgggtttacggggttaccggggtacccggttaaccgggtaccccgttaaccccgttaacggtttacccggtttaccggttttacccgttttacccgtaaccgtttttacccccccgg

SEQ ID NO: 17665 - DNA, 561 bp, Homo sapiens
  misc_feature: GYAE6OF01BCGSP.3.3.A03.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccacctgtctttgtctccaggggaanagccaccctctcctgcagggccagtcagagtgttagcagctacttagcctggtatcaacagaaacctggccaggctcccaggcctcctcatctatgatgcatccaacgcgggccacgtggcactcccagcctaggttcaggtggcaggtgggtcgngggacagcttcactcncacatcgagtacgccgtagacgcctagtagtagtttgactagtcttattattgtacaacgngtcggtagctaacgtcggtcccgtcgggtcggtaccgttcgggaccgtaacgggaccgaagggtacgaaacgtacgaaaccgtacgtggtacggtctacgacacccgtgttaccgttagtccttctcgttcccg

SEQ ID NO: 17666 - DNA, 834 bp, Homo sapiens
  misc_feature: GYAE6OF01D3Y7K.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctccagataccaccggagaaattgtgttgacacagtctccagccaccctgttctttgtctccgaggggaaagacgcccaccctctcctgcgagggccagtcagagtgttagcagtctacttagcctggtatacaacagaaacctggaccaggcctcccgaggcctcctcatctatgatgcactccaacgcgggcccacgtcggacctactccccgagtccgtaggttccgaaggtcggacgtaggggttcggggtcgtaggggacctaagtaccttacgaccttcctaccgacctagttaccgtaacggtaacgtaccgttaacggtaaccgtacccgttaagggtaaacggtttatttttacgggtaccttaacgtttaccgtttaagttttaacgtttacggtttaacctaaaccggtaacgggttacccggttacgggtacccgttaaacccgggtttacccgggttaacccccggtttccgggggtttaaccgggggtttacccccgggttttacccggggaacccgggtaaaccgggggtaacccgggttaaaaggggttaaccggggttaaaaacccgtaacccgggttaaaaccccggttaaccgggttacgggttaccggggtacccttaccgggaacccctaacccgttaccgtttacccgtttacccggtttccctttaccccgtaccgtttccccccg

SEQ ID NO: 17667 - DNA, 629 bp, Homo sapiens
  misc_feature: GYAE6OF01DD27C.3.3.A03.1.454.CMB.1.raw
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (280)..(280): a, c, t, g, unknown or other
  misc_feature (280)..(280): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctcagccacctgtcttgctcgagggaangccacctctcctgcagggccagtcagtagtgtagcagctacttagcctggtatcaaanacgtaacctggccaggcctcccgaggcctccncattcatgatcgacactaccgaaacgtcgggccctagtcgggactacgtccccgaagccctaaggttcagttcggctaggtcgggctaggggactagtccttacactcgtacaccgtataccgagtacgtaccgtaagaccgtaccgtagtaacgttagttttacgacgttacgttacttaatttacgttacgtactaacgtacggtacgtcggtacgtaacgtcggtcccgtacggtcggtacgttaccggtaccggaacgggtaccgtaacgggtacgtaaacgtacgaaaccgtacgtacggtaggtccgtagacctactacgtctaggttccttcgtcttacccg

SEQ ID NO: 17668 - DNA, 852 bp, Homo sapiens
  misc_feature: GYAE6OF01C66F3.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaaggggaaagcgcccaccctctcctgcagggccagtcagagtgttagcagcttactagcctggtatcaaacacgaaacctggaccaaggcctacccgaggtcctacctctatcctagtgtatcgactactaccgaacgacgggcctaacggtcggacctaaccgtccccaacggacccgtaacggttacgaacggtcggaccgtaagggttcggggtaccgtaggggaacctacggtacctttacgaccctttccgtaacctaacccgtaagttcccgtaacggtaaccgtacccgttaacgggtaaccggttacccgttaacgggtaaaaccggttttacgtttttacgggaaccgtttaacgtttaccgttttaaagttttacgttttaccggtaacttaaaccggtaacgggttccgggtttaaccggtacccgttaaaccgggttcccgggtaccccggttacgggttaccggggttaccgggtttacccggggaaccccggtaacggggtaaacccggttaaaacggggttaacggtaaaaccgttaaccccggaaaaccggttaacccgggtaggttacccgggtaccgtaccggtacccctaaccgttacccgtttacttaccgggttttcccttacccgttacccggttacccccg

SEQ ID NO: 17669 - DNA, 750 bp, Homo sapiens
  misc_feature: GYAE6OF01A73WM.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagcgccaccctctcctgcagggccagtcagagtgttagcagctacttagcctggtatcaacagaaacctggccaggcctcccaggctcctacatctatgatcgcactacccaaacgcgggacccacgtacggcacttacccccgagaccgtagggttcaagggttcggcgtaacgggttcggggtaccgtgggggaactaggtaaccctttacctacttacccttaccgaaccctagttccaaacggttacgacccgtgtaccgtaaggttaccttaggtaaacgtttactttaggtacctttaactttttaacgttttcgttcgttacgtacgtacgttaaggttaaactttaaacgtaaacgttccgggttacccgttacccggggttacggtaaccggggtttccgggaacccggggggttaaccggtaaacggggttgggaaaccggtaaccgtaaaccggtaaaacggttaaccggttagggtaccggtcgtacggaccctaaccgttacggttactttaccgggttacctttccgttaccgttaccccgg

SEQ ID NO: 17670 - DNA, 832 bp, Homo sapiens
  misc_feature: GYAE6OF01C267R.3.3.A03.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
tcagagacgcactccacgaccggtgctcgatttagagagcgtcacagggggaggaactgctcagttaggacccagagggaaccatggaagccccagctcagcttctcttcctcctgctactctggctccagataccaccggagaaattgtgttgacacagtctccacgcccacctgtctttgtctccgaaggggaaanacgcccaccctctcctgcagggccagtcagngtgtagcagcttacttagcctaggtactaccaaagaacgaaacctggaccaggccctacccgaggtcctcctcattctatgtatcgactactccgaaacgcggccacgtcggaccactcccgacgccgtaggttcacgtcggacgtagggtcgggtcgtagggaacctaggtaccttacgaccttcacctaaccgtactacgtacgtaaccgtccctaagggaccgtaccgttaagggtaaaacgtttgttttaacggaccgttaacgttttacgttttaacgttaaggttttacgtaaacccgtaacgggtttacggttaccggggttaaccgtaaccgttaaacccgggttccccggggtaccccgtttaggggttaccccggggtaaccgggtttccccgggaaaccggggttaaaccgggggtaaaccccgttaaaagggggggttaaaacccggtaaaaccggttaaccccgggtaaaaccccgggttaacgggtttacccgggttacggggtaccccttaacggtaccccgaaccggttttaccggttacccgttttacggtttaccccttaccgggtttaccctttacccccccgg

SEQ ID NO: 17671 - DNA, 733 bp, Homo sapiens
  misc_feature: GYAE6OF01C8ONH.3.3.A03.1.454.CMB.1.raw
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
  modified_base (503)..(503): a, c, t, g, unknown or other
  misc_feature (503)..(503): n is a, c, g, or t
tcagagacgcactccacgaccggtgctcgatttagagagcgtcacgagggggaggaactgctcagttaggacccagagggaaccatggaagccccagctcagcttctcttcctcctgctactctggctcccagataccaccggagaaattgtgttgacacagtcctccagccaccctgtctttgtctccgaaggggaaanacgcccaccctctcctgcgagggccagtcagtagtgttagcagtctactagccgtggtatacaacacgaacctggaccaggcctcccgaggcctcctcattctatgatcgactactaccgaacgacgggccacgtggacctactcccgagacccgtaggttccgaggtcggcgtaggggttcgggtcgagggaaccncggtaccttcgaccgttcaccaacattacgacgtacgtacctaagacgtccgtaagaagtttgtttacgacttacgttattaagttttacttacgtaccgtaacgnggttaccggtacggtaccgtaacggttcccgggacccgtttcggggttaaccggggtacccgggtttaccggggaacccgtaaacgggggtaacccggtaaacggggtaaacgtaaaacccgtaccgggtaaaacccggtacggttacgggtaccgggtccgtaccggtacccgtaaaccgtttgttacccggtttacttaccctttaccgtcccggttttaacccccgg

SEQ ID NO: 17672 - DNA, 685 bp, Homo sapiens
  misc_feature: GYAE6OF01DRSSS.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaagngcccaccctctcctgccagggccagtcagagtgttagcagctacttagcctggtatcaacagaaacctggccaggcctcccaggctcctacatctatgatgcatccaacgacgggcccacgtcggacactccccgagcctaggttcaggtcggctagggttgggtcgtgggactagtacttcacttctcacctatcgagtacgcctagtacgtccgtaggtaagttattttagactagttactttaagtttacgttgttacgaacgtacggtcggtacgggtactaaaccggtccgggttaccccgttcggggttacgggtaccgggtttacccgggaacccgggtaaacgggggtaaccccgtaaaggggtttaaccgggaaaaccgttacccggaaaacccggttaaacgttcgggtacggttacccgtacggaccgtaacccgtagtttacccgttgtttacccttccttaccgtttaccccccgg

SEQ ID NO: 17673 - DNA, 666 bp, Homo sapiens
  misc_feature: GYAE6OF01ESKU0.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagcagtctacttagcctggtatcaacagaaacctggccaggcctcccaggcctcctcatctatgatcgcataccaacgacgggcccacgtcggccactccccagcctaggttccaggtcggcgtaggtggggtcgtaggggactacggtaccttcacctccgtacaaccctattaccaggttacgacccgtagacgtccttaaggtaacgttattttacgctaagttaccttatttaacgtttgtactaacgtagtaccgtcggtactaaccgttcgggtccccgttacgggttacgggtacccgggtttcgggaacccggaaacggggtaacccgtaaaggggtaacggtaaaacgtaacccgaaaccggtaacgttacgggtggtaccgtacggacctacccgtacgttaccgttgttaccttcgtccttaccccg

SEQ ID NO: 17674 - DNA, 826 bp, Homo sapiens
  misc_feature: GYAE6OF01E4QL8.3.3.A03.1.454.CMB.1.raw
  modified_base (199)..(199): a, c, t, g, unknown or other
  misc_feature (199)..(199): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagtaaattgtgttgacacagtctccagccaccctgtctttgtctccgaaggggaaancgccctaccctctcctgcagggccagtcagagtgtagcagctacttagcctggtactcaacagaacctggccaggctcccgagcctctcatctatgatcgacactacccgaacgtacgggccctaacgtgggacctaaccgtccccgaggtacccgtagggtttaccgaacggttcgggaccgtaaggggttcgggggttacccgtagggggaacctaacgggtaaccctttcgaacccgtttacctaaaccgatttaccgaaggttacccgtaccgtaacggtacgtaccgttaaggtaacggttacgttttacggacgttacgtttactttaagttttacgttacgttaaccgtaaccgtacgggttaccggttacgggaaccgtaacggttccgggtaaccccggtttcgggtacccggggttaacccggttacccggggtaacccggtaaacgggggtaacccggtaaacggggttaaccgggtaaaccgttaacccgggtaaaacccggttaaccgggttacggttaccgggtaccggtacccggtaacccgtaacccgttaaccgtttacccggtttacggttaccttttacccgttacccgttcccccgtttacccccgg

SEQ ID NO: 17675 - DNA, 701 bp, Homo sapiens
  misc_feature: GYAE6OF01EI4AV.3.3.A03.1.454.CMB.1.raw
  modified_base (102)..(102): a, c, t, g, unknown or other
  misc_feature (102)..(102): n is a, c, g, or t
  modified_base (332)..(332): a, c, t, g, unknown or other
  misc_feature (332)..(332): n is a, c, g, or t
  modified_base (527)..(527): a, c, t, g, unknown or other
  misc_feature (527)..(527): n is a, c, g, or t
  modified_base (651)..(651): a, c, t, g, unknown or other
  misc_feature (651)..(651): n is a, c, g, or t
  modified_base (686)..(686): a, c, t, g, unknown or other
  misc_feature (686)..(686): n is a, c, g, or t
tcagagacgcactccacgaccggtgctcgatttagagagcgtcacgagggggaggaactgctcagttaggaccagagggaaccatggaacgccccagctcancttctcttcctcctgctactctgcctcccagataccgacggagtaaattgtgttgacacagtcctccacgcccacccttgttctttgtcctaccggaaggggaaacgacgtcccaccctctccgtgcgacgggcctagtcagtagtgttagcagtcctactacgctggtaacacaaacaacgtaaaccgtggaccgaaggcctcccgaggtccttccactataccttagnggtactgtacctaactaccgaacggaccgggaccacgtggacctaacgtcccgaacgtccgtaggttacgaggtcggcgtagggtcggggtaccgagggtaccgtacgtaaccttcacctacctacaaccgtataccgtagtaccgacgttacgactagttaacggtatatttcgaaccttagttacttagtttntaccgtaataacgcgtacggtacgaaccgtaggtccgaccgttggtacggtaccgtcggaacggacggtaaccgtaaagggttacggaaacccttacgggaaaaccctggtagggttacccggntaaaccggcctaaacttccggtattcccggtttanaccgtacgttccccg

SEQ ID NO: 17676 - DNA, 978 bp, Homo sapiens
  misc_feature: GYAE6OF01A9I14.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtcctccagccaccctgttctttgtctccgaggggaaagacgcccaccctcctccgtgcgacgggccagtcgagtagttgttacgcagtccttacgttagccgttaggtactaccgaaacgaacgtaaacccgtcggaccgacgggcccttacccgaacgggtcccttacccttacctactttaccttaacgttacggtacttcggaccctaacgttaccccgaaaaccgggtaccgggggacccctaaccggtcgggtacccaacccgttaccccccgacggtaccccgttaacgggttaccgaacgggttaccgggtaccggttacggggtttacgggggtaccgggttacggggtaaacccggtaccggttaacccgtttacccgtaacctttccctaaccgtaaaccccttagtaacccgtaagggttaacccggtaccgttaacgggaacccggttaccccggttaaaggttaaacggtttaaccgtttttacgggtacccgttaaaggttttaccttttaaggtttttaaccgtttacggttaaaacccgtaacgggtaccgggttacggttaacggtaccggaaccgtttccgggtaccccgtttaccggggtaccgggttaacccggggttaccgggtaaacccgggtaaccgggggttaaacccgggtaagggtaaccggggtaaaaaccgttaaccccggtaaaccgggaaccgggtttacgggtaccgggttaccggtacgtaacccgttaaaccgtcggttttaccgttaccggtttacccttcccgttaccgtttaaccccccgg

SEQ ID NO: 17677 - DNA, 680 bp, Homo sapiens
  misc_feature: GYAE6OF01DP1II.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctccagataccaccggagaaattgtgttgacacagtctccagccacctgtctttgtctccgaaggggaaangcccaccctctcctgcgagggccagtcagtagttgttagcagcttacttagcctaggtactccaaacaacgaaaccgtggccaacggcctacccgaggtcctcctcatctatgatgactactaccaacggacgggccacgtcggactactccccgagacctaggttcaggtcggcgtagggttcgggtcgtacggggaactacggtacctttcgacttcctacgaacctattaccgtaagtaacgtccgttaaggacgtaccgtaggtaagttattttcgactacgttacttagtttacgttcgtaactaacgtaggtcggtacggactaaccgtccggtcccggttacgggtcggtaccggttcgggaacccgtaacggggaaccgtaaacgggtaacggtaaacgtaccgaaaccggtaacgtgggtacggtcgtacgtaccgtaaccgtacttccgttacgtttccttcgtaccgttcccg

SEQ ID NO: 17678 - DNA, 769 bp, Homo sapiens
  misc_feature: GYAE6OF01DS6UK.3.3.A03.1.454.CMB.1.raw
  modified_base (230)..(230): a, c, t, g, unknown or other
  misc_feature (230)..(230): n is a, c, g, or t
tcagagacgcactccacgaccggtgctcgatttagagagcgtcacagggggaggaactgctcagttaggacccagagggaaccatggaagccccagctcagcttctcttcctcctgctactctgctccagataccaccggagaaattgtgttgacacagtctccacgccaccctgttctttgtctccgaaggggaaagagcccaccctctcctgcgacgggccagtcagngtgtagcagctactagcctaggtatacaaacaacgaaaccgtggaccgacggtcctacccgacggtcctcctcatctatgatcgactactaccgaacgacgggccctacgtcggaccaccgtccccgacgccgtaaggttccgaggtcggacggtagggtcggggtcgtaggggactaaggtacccttacgtaccttaccgtacctaaccgtacgttaccgtaacggtacgtaccgtaaggaccgtaccgttaaggtaagtttacgttttacggaccgttaacgtttactttaacgttttaacgttagtaaccgtaaccgttacgggtcggttacggtaacccgtaccggttaccgggttccccgttacgggtaccggggttaaccggtttacccgggaacccgggttaacggggaaaacccgttaaacggggtaaacggttaaaacccggtaaccggaaacccggttaacggttagggtaccggtcgtaccggacctaccgtacgtttaccgtcgtttaccttaccgtccgttccccg

SEQ ID NO: 17679 - DNA, 735 bp, Homo sapiens
  misc_feature: GYAE6OF01BE7OH.3.3.A03.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgagggaangccacctctcctgcaggccagtcagngtgttagcagctacttacgcctggtatcaacaacgaaaccgtggaccaggcctcccgaggcctcctcactcctatgactgcactacccaacgacgggcctagtcggaccacgtcccgacgcccgtaggttccaggtcggaccgtagggttcggggtccgtaggggaaccgaggtacctttaccgaccttaccgtacctaacccagttaccgaacggtaccgtcccggtaaaggtaccgtccgttaaggtaaacgttacgttttacgaccgttacggtttacttaacttttagttaccgtaacgtaacgacggttcggtaaccgtaccgtaacgttccgggtacccgttcgggttaccgggtaccgggtttaccgggacccggtaaaccgggtacggtaaacgggtaacggtaaaacccttacggaaaccccggtaacggttcggtacggtcctaccgggaccctaacccgttactaccgtttaccgttcgtttaccctaaccggttttcccccg

SEQ ID NO: 17680 - DNA, 673 bp, Homo sapiens
  misc_feature: GYAE6OF01DA90W.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagcccacccttgtctttgtctccgaaggggaaagacgcccaccctctccgtgcacgggccagtcagtagtgttagcagtcttacgttacgcctaggtactacaacaacgtaacctggaccaggtccctcccgaggtcctccgtactattctatgatcgacactaccgaacgacgggccacgtcggacctactaccccgagtcccgtaaggtttcgaggttcggacgtagggttcggggtccgtaggggactaacgtaccttcacgttcctaccgactacgtcgtaacgtacgtacccgtagaccgtaccgtaaggtaagtttacgtttacgacttaggttacttaagtttacttacgaactaacgaggtcgtacggactacggtccggtcccgtacggtacggtaccggtacggaaccgaacgggaccgtaagggtaacgtaaacgtacgaaccggtaacgtggacggtctaccgacaccgtcttacgtgttccgtctacgttcccg

SEQ ID NO: 17681 - DNA, 817 bp, Homo sapiens
  misc_feature: GYAE6OF01EPG9V.3.3.A03.1.454.CMB.1.raw
tcagagacgcactccacgaccggtgctcgatttagagagcgtcacgagggggaggaactgctcagttaggacccagagggaaccatggaagccccagctcagtcttctcttcctcctgctactctggcctcccagactaccaccggagtaattgtgttagacacacgtctaccacgccctaccttgttctttcgtcctaccggaagggggaaagacgccctaccctctcctgcgacgggccagtcaggtagttgttacgcgagtccttacgttacgtccgttaggtactaccaaaccgtaacggtaacccgtcggacccaacgggtccccttacccggacggtccttaccctactacttactagtgtactcgacctacgtacccgaacggcggaccctacgtccggacctaccgtaccccgacggtaccgttagggttccgagggtacggtcggtacggggttcgggtacggtacgggtaacccgtaacggttaccttacgtacccttacccgtaccctaacgttaccgtacgtaacggttaccgtaccgttaacggacggttaccgttaaaggttaagtttcgtttacgaccttagttttactttaagtttacgtcgttaacacggttacggttaccggttacgaccgtaccggttaccggtcccgttacgggtaccgggttaccggttaccgggaaccgggtaacggtaccgtaagggtaccgtaaaccgaccggtaaacccggtgttcccgggacgtacccgccgtaaccgtcttcggtaccttaccggtttccctaactcccgttacccccgg

SEQ ID NO: 17682 - DNA, 882 bp, Homo sapiens
  misc_feature: GYAE6OF01EZ0ZR.3.3.A03.1.454.CMB.1.raw
tcagagacgcactccacgaccggtgctcgatttagagagcgtcacgaggggggaggaactgctcagttaggacccagagggaaccatggaagccccagctcagcttctcttcctcctgctactctggctcccagataccaccggagaaattgtgttgacacagtctccagccaccctgtctttgctccgaggggaagacgcccaccctctcctgcgacgggccagtcagtagtgttagcagccttacttagccttggtactacaacgagaaacccgtggaccaggccctacccgaggtcctccgtacatcctatcgtatcgacctactaccccgaacggtacgggaccctacggtacggaccctacgtaccccgaacgtacccggtaggttaccgtacggggtacgggaccggtacggggtttcggggggttaccggtacgggggtaaacctacgggttaacccctttaccgtaacccttacccgtacccaacccgttaacgttaccgtaagggttaacccggtacccggttaaacggtaccgggtacccgttaacgggtaaacggttttaacggtttttaccggtaaccgttaagtttaccgttttaaatttttaaccgttacggtttaaacccttaaacggtacgggttaccggttacgggtaacccgtaacccgggttcgggtaccccccggttaggggttaccggggttacccgggtttaacccgggaacccgggttaaccggggtaaaccggtaaaggggtaccgttaaaaccggtaaccccggtaaaacccgggtacgggtttacgggcggttaccggtccggaaccgtacccgttaacggttaccttaccgtttaccctttacgctttaccccgg

SEQ ID NO: 17683 - DNA, 733 bp, Homo sapiens
  misc_feature: GYAE6OF01CXPDP.3.3.A03.1.454.CMB.1.raw
  modified_base (199)..(199): a, c, t, g, unknown or other
  misc_feature (199)..(199): n is a, c, g, or t
tcagagacgcactccacgaccggtgctcgatttagagagcgtcacagggggaggaactgctcagttaggacccagagggaaccatggaagccccagctcagcttctcttcctcctgctactctggcctcccagataccaccggagaaattgtgttgacacagtctccagccaccctgtctttgtctccgaaggggaaangcccaccctctcctgcagggccagtcagagtgttagcagctacttagcctggtatacaacaagtaaacccgtggaccacggcctcccgaggcctcctacactctagtgatcgactactacccgaaacgcgggacctacgtcggacacctccccgagtccgtaggttcgaggtcggacgtagggtgggtccgtagggaacacgtacttccacttccacacctatcgtagtacgtaccgtaggacgtaccgttagtaaacgttagttttcgacgtagttactttaagtttacgttacgtacctaacgtacggttccggtaggtaccgtaaccggttccgggaccccgtttacggggttcgggttaacccggtttacccggggaacccgggtaaacgggtaacccgggttaaacgggttaaaccgggtaaacgttaaacccggaaaccccgttaaacggttcggggttaccggccttacggaacccctacccgtagtttcccgtttacggtttcccttacgtacccgttttcccccg

SEQ ID NO: 17684 - DNA, 531 bp, Homo sapiens
  misc_feature: GYAE6OF01BDBFL.3.3.A03.1.454.CMB.1.raw
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (523)..(523): a, c, t, g, unknown or other
  misc_feature (523)..(523): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccacgtggcatcccagccaggttcagtgcaggtgggtctgggacagacttcactcncaccatcagtancctagngcctgaagtatttgctagtctattattgtacaacagtcgtgcaacgtcggccgtcggtggtaccgttcggaccgaagggaccgtaaggtaggtaaataccgaaaccggtagtaggacggcgtcgacaccgtatctagtcttcncgttcccg

SEQ ID NO: 17685 - DNA, 737 bp, Homo sapiens
  misc_feature: GYAE6OF01A4IWF.3.3.A03.1.454.CMB.1.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (400)..(400): a, c, t, g, unknown or other
  misc_feature (400)..(400): n is a, c, g, or t
tcagagacgcactccacgaccggtgctcgatttagagagcgtcacagggggaggaactgctcagttaggaccagagggaaccatggaagccccagctcagcttctcttcctcctgctactctggctcccagataccaccggagaaattgtgttgacacagtctccagcccacccttgttctttgtctccgagggggaaancgcccaccctcctccgtgcgacgggccagtcgaggtacgttgttacgcacgtccttaacgttcgccgtggtaactacaaacgaacgaaacctcggaccgaggcctacccgngtcctcctacacgttctaagtcgatcgactactaccgaacgcgggacctacgtcggacctacgtcccgagccgtacgttcgacggtcgnggtacgggtgggtccgtaggggaactagtaccctttacgtaccttaccgtaccgaaccttacgtaccgtacggtacgtaccgtagacgtaccgttaagtaaacgttttcgtttacgacgttaagttacttttaaagttttcgtacgtaaccaacggtcggtacggtacgtacccgtaacgggttcccggttaccggttccgggttaacggttaccggttacgaaccgggtaaccggaacgggttaaaccggtaaagggtaccgtaaacccgtaaccggtaacggtacggtaggtcgtaccgacgaaccctctaccgttcgttacctccttcgtcccg

SEQ ID NO: 17686 - DNA, 652 bp, Homo sapiens
  misc_feature: GYAE6OF01DTJ1T.3.3.A03.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
tcagagacgcactccacgaccggtgctcgatttagagagcgtcacagggggaggaactgctcagttaggacccagagggaaccatggaagccccagctcagcttctcttcctcctgctactctggcctcccagactaccaccggagaaattgtgttgacacagtctccagccacctgttctttgtctccgaaggggaancgcccaccctntcctgcagggccagtcagattgtagcagctactagctgatcaanagaactggccagctccnggctcctcatctatgatgcacgtcccgacccgggtcctacgtacggtacctacccgacgccgtaggtcacggtacggcgtaggtcggggtctacggaacgtaggtacgttccaacgtcctaccacctaactcgaacgccgacgccgtaggcgttaccgtaggaacggtaacctcgtacgtacttagttttaactacgttaggtacacggtactagttaagttaacgttacggtacggtccggttacgggtaccggttacggaaccgggtaacgggtaaccgtaggtaacggtaaactaaccgaaacggttacgtaggtccggtacgtacgaccaaccgtgttaccgttcttacccttacacccgtttcccttccccggtcc

SEQ ID NO: 17687 - DNA, 901 bp, Homo sapiens
  misc_feature: GYAE6OF01DOVI3.3.3.A03.1.454.CMB.1.raw
  modified_base (859)..(859): a, c, t, g, unknown or other
  misc_feature (859)..(859): n is a, c, g, or t
tcagagacgcactccacgaccggtgctcgatttagagagcgtcacagggggaggaactgctcagttaggacccagagggaaccatggaacgccccagctcagtcttcctccttcctcctgcctactctcggcctcccagactaccgaccggaagtaaattgtgttgacacagtcctccacgccactacttgttctttgtccgtaccggaaggggaaacgccgtacccctaccccttccgtacccgtcggaccggtacggggaccctacggttacgaaggttacggttaggtttaacgaccgaacggttacctttaaccggtttaccggtacccgttaggttaacctaaccgaaaaccgtaaaaccggtaaaccccggtccggggaaccccgtaccggggtacccccttaccccgggaacggttaccccttccccttaccgttaactttaccgttaagtacggtactaccggtaccctaaccggtacccgaaccgggtaccgggacccttaaccggtcggaccctaacccgtcccccgtaacggtacccggtttagggttaccgacggggttacgggtacccgggtagggggttaccggggtttacggaaccggggtaccttaaccggttacccgtttacccgtaaccttcccgttaaaccgtaccctacgttacgtaacgtcgtaaccgtagtaccgtacttaaggttaactttgttacgacgttagttactttatttacgttagtaaccgtaacgtggtaccgacgtccgtaaccggtccgtcccgggttaggtaccggtaccggttacggacggaacggtacggtaggtaacgtaaccgacgtaaccgtgtaacggngtccgtacgacttaccgtcgttacctcgttcttaccgtcccg

SEQ ID NO: 17688 - DNA, 828 bp, Homo sapiens
  misc_feature: GYAE6OF01EAIJE.3.3.A03.1.454.CMB.1.raw
  modified_base (261)..(261): a, c, t, g, unknown or other
  misc_feature (261)..(261): n is a, c, g, or t
  modified_base (813)..(813): a, c, t, g, unknown or other
  misc_feature (813)..(813): n is a, c, g, or t
tcagagacgcactccacgaccggtgctcgatttagagagcgtcacagggggaggaactgctcagttaggacccagagggaaccatggaacgccccagctcgagtcttctccttcctcctgctactctcggctcccagactaccaccggagaaattgtgttgacacagtctcacgccacccttgttctttgtccgtaccggaaagggggaaagaccgtccctaccctctccgtgacggacgggccagtcaagtgtagtagcncgtacttacgtagtcgtagtataccaaacgtaacgaaccggtcgaccgcggccctccgacggtcctcactactactatgtactcgactaccgaccgaacggtacgggtcctacgtcggtacctaccgccccgaggtccccgtaaggttccgaggggtcgaggtacgggttcggggtacggtacgggaacgttacgtaccgttaccgtacccgtacctaccgtaaccgtactaacggtaacggtaacgtacccggtaacggtaaccgtacgtaaacgggtttaactttaccgttttaaccggggaatttaccgggttttactttaaagttttaacgttaccggtaaacccgtaaacgggtacggttaccgggtaaccggttacgtaaacccgggttcccggtaacccgggttaacgggttcggggtaacccgttacggggaaaccgggtaacgggaacccggaaaggttaacggaacctaccgggtaaaccggtcggttaccggtgtccggtaacccgccgttaaccgtactttacgtcgtttaaccccgttnaacccggtttcccgg

SEQ ID NO: 17689 - DNA, 682 bp, Homo sapiens
  misc_feature: GYAE6OF01AURE9.3.3.A03.1.454.CMB.1.raw
tcagagacgcactccacgaccggtgctcgatttagagagcgtcacaggggggaggaactgctcagttaggacccagagggaaccatggaagccccagctcagcttctcttcctcctgctactctggctcccagataccaccggagtaaattgtgttgacacagtctccagcccaccctgtctttgtctccgaaggggaaagcgcccaccctctccgtgccgacgggccagtcaggagttgttagcgagcttacgttagcctaggtatacaacaacgtaaaccgtcggaccgacggtcctacccgaggtcctcccgtacattcctatcggatcgcactaccaacggacggaccctacgtcgcacctcccacgccgtacggtacacggtagcgtaggtcgggtcgtagggactacgtacttctaaccgttccaccgtactactacgtacgtaaccgtacgtacgaaccgtccgttaaggtaacgttacgttttagaccgtttaagttctttaacgtttatttacgtaccgtaacgtcgtacggtacgacgtaacgtcggtcccgtacggtccggtacggttaccggaccggaacggtaccggaaggtacgtaaaccgtacgtaaccggtacgtggtccggtagtaccgtcaacccgtagttccgtatccttacgtccttacccg

SEQ ID NO: 17690 - DNA, 724 bp, Homo sapiens
  misc_feature: GYAE6OF01A9CJ5.3.3.A03.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (329)..(329): a, c, t, g, unknown or other
  misc_feature (329)..(329): n is a, c, g, or t
tcagagacgcactccacgaccggtgctcgatttagagagcgtcacagggggaggaactgctcagttaggaccagagggaaccatggaagcccagctcagcttctcttcctcctgctactctggctcccagactaccacggagtaaattgtgttgacactagtcctccacgcctaccttgttctttgtcctaccgaagggggaaacgcgccctaccctctcctggcgacgggtccaggtcaggngttcggttacnctacgcttactagccgttaggtactacaacacgaaccgtggccaggcctccgagtcctccactactctgtgtacncgctaacgtaccgaacgcggaccacgtcggaccacgtcccgagtccgtaggttcacgggtgcggtaggttcggggtacgtagggactaacgtacgttctacctacgtacctactacggttacgaacgtacgtacgtacggtaccgtacgtaacggtaatttcgttttacacggtttacttacgttttaactacgtttacgtaacaaccgtaggttccggttacgacggttaccggtaccggttaacccggtcgggttaccgggtaccggttaccgggaaccggaaaccggggtacgtaagggtaccggtaaaactacccgggaaacgtacggtagggtcgtacggtaccgaccgtaacttcggtactttaccggtacttacctcccgttacccgg

SEQ ID NO: 17691 - DNA, 798 bp, Homo sapiens
  misc_feature: GYAE6OF01BMLSI.3.3.A03.1.454.CMB.1.raw
tcagagacgcactccacgaccggtgctcgatttagagagcgtcacgagggggaggaactgctcagttaggaccagagggaaccatggaacgcccagctcagcttctcttcctctgctactctgctccagactaccgacggagtaattgtgttgacactagtctcacgcctaccttgttctttcgtcgtaccggaaggggaagacgccaccctctccgtcgcgacggcacgtcgagtagtgtacgctacgtcttacgttacgtccgttaggtactacaacgaacgtaaaccgtcggaccgtacggtaccctacccgacggtcctcctactactcttagtgactcgactacctaccgaacggtacggccaacggtcggaccaccgtccgacgtaccgtacggtacgtaggtcggtacggtacgggtcgggtacggtacggtacgtacgtacttacctacgtacctaccgactacgtacgtacggtactacgtagtacgtacgtagttaacttagtttacgaacgtttacgtttaactttaagtttacgtacggtaaccaaggtccggttacggtaccggtaaccttaccggggtaccggttacccgggttacgggttaacggggttacccggtttaaccggggaaccgggtaaacggggaacccggttaaagggtaaaccgggtaaaaccgttaacccgggaaacggttaccgggttagggtaaccggttccaaccggtacccggttaaaccttcgggtttacccttacggtttacccttaaccgttcccgttaccccgg

SEQ ID NO: 17692 - DNA, 727 bp, Homo sapiens
  misc_feature: GYAE6OF01B12L2.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccacctgtctttgtctccgaggggaangcccaccctctcctgcagggccagtcagagtgtagcagctacttagcctggtatacaacagaaacctggaccaggcctacccgaggtcctcctcatctatgatgctatccaacgcgggccagtcggactacgtcccagcctaggttccaggttcggacgtagggttcgggtacgtaggggaacacggttaccttcaacccttcctaccgaaccctagttaccgaacggttacgacccgttaaggacggtcccgtaaggtaaacgtttagttttacgaacgttaagtttacgtttaatttaacgttcgttaacctaaccgtacgggtaccggtaggtacccgtaaccggttcccgggtaccccgttacgggttacggggttacccggttacccgggaaccggtaaacccggggtaaccgtaaaggggtacggtaaaacgtacccggtaaaccggtacgggttaggtacgggaccgttacggaacccgaccgttacttacccggttacttaccgttcgtacccgtttacccccg

SEQ ID NO: 17693 - DNA, 897 bp, Homo sapiens
  misc_feature: GYAE6OF01E03EI.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctgctcccagataccacggagaaattgtgttgacacagtctccacgccctacccttgttcttttcgtcctaccggaagggggaaagcgccctacccttctcctgcgacgggccagtcaggtagtgttagcagtcttacgttagccgttaggtactacgaaaccgaacgaaaccgtcgggaccgacggccctcccgaggtcctcctacacttctagtcgatcgactaccgtaccgaacggtaccggcctacgtcggaccctaccgtcccgaacgtccgtaacggtttccgaggtcggtacgtcgggttcggggtaccgtaggggtaactacgttacccgttacgtacccttaccgttaaccgacccttagtacccgtaaacgggttacgtacccgttaaagggccggtaaccgtttaacggttaaaggtttttacgttttaccggaaccgttttaacgtttaccgttttaaagttttccgttaaacccggttaacaaccggttagggtttcccgggtacggaacccttacccgggttccggggttaccccgggtttacgggttaacccgggggttacccgggtttaacccgggaacccgggtaaaacgggggtaaccggttaaaaggggggtaaacccgttaaaacccgtaaaccccggggttaaaaccccgggttgtttaccgggggggtaaccgtcccggttacccggaaacttacccccgtttgtttacccgttaccggttttccctttaacccggtccccttttacccccggg

SEQ ID NO: 17694 - DNA, 816 bp, Homo sapiens
  misc_feature: GYAE6OF01B2HLD.3.3.A03.1.454.CMB.1.raw
  modified_base (122)..(122): a, c, t, g, unknown or other
  misc_feature (122)..(122): n is a, c, g, or t
tcagagacgcactccacgaccggtgctcgatttagagagcgtcacagggggaggaactgctcagttaggacccagagggaaccatggaagccccagctcagcttctcttcctcctgctactntccccggctcccagactaccaccggagtaaattgtgttgacacagtcctccacgccctaccctgttctttgtcctaccgaaggggaaagacgccctaccctctccgtgcgacggccagtcagtagtgttagcagtctacttacgcgtaggtactacaaacaacgtaaaccgtcggaccacggtcccgtacccgacggtccttcccgtactaactcctagtacgtactcggacaacctaccgaacggaccggaccctacgtcggaccacctcccgacggtccgtacggttacaggtcggacgtacgggtcggggtaccgttagggaactacgtaccgttacctacctcctaccaccgttactacggtaacggtacgtaccgtaacggtacgtaccgttaaggtaaacgttttacgtttacggaaccgtttacgtttaactttaacgttttagttacgtaaaccaacggttcgggtacggtaccggtacctaacccgggttcccggtacccggttacgggtaccgggttaaccggttacccgggaaccgggtaaccggggtaaaccgggtaaaaggggttaaacccggtaaaccttaacccgggtaaaccgggttacgtagggtaccggtcccgtaaccggaccctaacccgttcgttacccgtttacggtcccctttaagtcccccttcccccgg

SEQ ID NO: 17695 - DNA, 742 bp, Homo sapiens
  misc_feature: GYAE6OF01BH6EJ.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtcttgtctccgaggggaaancgccaccctctcctgcagggccagtcagagtgtagcagctacttgcctggtatcaacagaaacctggaccaggcctcccgaggcctcctcattctatgatcgacactaccgaaacgacggggtcccaacgttcggaccaacgtccccgagtaccccgaaggttacaggtcggactaagggttcggggtcctagggggaaccaggtaccctttacgaacttccgtacctaacccgaattaccgaacggttacgacccgttaacggaacggtaccctttaagggaaacgtttacgtttttacgggaacctttacggtttacttttaaagtttacgttacggtttaaccgaaaccgtggtacgttaccgggacgtaaacccgttaccgggtccccgttacgggttcgggtaacccgggttttcggggaacccgaaccggggtaaacttaacggggttaacggaaaacgtacccggaaaacccggtacgttacgggcggtcgtacgtacccacgttacttccgttagttacccttcgtacgttacccccg

SEQ ID NO: 17696 - DNA, 790 bp, Homo sapiens
  misc_feature: GYAE6OF01BXHG7.3.3.A03.1.454.CMB.1.raw
  modified_base (208)..(208): a, c, t, g, unknown or other
  misc_feature (208)..(208): n is a, c, g, or t
tcagagacgcactccacgaccggtgctcgatttagagagcgtcacagggggaggaactgctcagttaggacccagagggaaccatggaacgccccagctcagcttctcttcctcctgctactctcggcctcccagactaccaccggagtaaattgtgttgacacgagtctccacgccaccctgttctttgtcctaccgaaggggaaanacgtcccacccttctccgtgccgacgggccagtcaagtagttgttacgactaggtaccttacgttacgccgttaggtactaccgaaacacgtaaacccgtggacccgacgggtccctacccgacggtccttaccgtactacgttaccgtaagtgtacttcgacctaacttacccgaaacggccgggtaccctaaccggttcggaccctaaccgttaccccggacggtacccgttaacgggttccggaagggttccggacggttacgggttcggggttaccgtacgggggtaacctacgttacgtacctcccgtactacccggaactacgtaccgtacgtactaccggtaacgaccgtacgttaaacggtagtttacgtttacgacgttacttcctttaagttacgttacgtaacaacggtacggtcccggttaagtaccgttaccgttccggcccggtttaggccggtttacccgtacgggaccgtaacgggtaacgtaacggtaagaaacctaacggaacggtcgttagggtcgaccgactaccgacttcgtaccttagttcccgttcgacccgtttcccg

SEQ ID NO: 17697 - DNA, 761 bp, Homo sapiens
  misc_feature: GYAE6OF01DEKP7.3.3.A03.1.454.CMB.1.raw
  modified_base (164)..(164): a, c, t, g, unknown or other
  misc_feature (164)..(164): n is a, c, g, or t
  modified_base (311)..(311): a, c, t, g, unknown or other
  misc_feature (311)..(311): n is a, c, g, or t
tcagagacgcactccacgaccggtgctcgatttagagagcgtcacagggggaggaactgctcagttaggacccaggagggaaccagtggaacgcccagctcagcttctcttcctcctgactactctggcctccagactaccgaccggaagtaaagttgtggttnacacgtacggtcctaccgacgccactcttcgttcgtttcgtaccgacggaagggggaaactccggccctaccttctccgcgtacgacgggcctaggacgtaagtagttcgttaggaccacgttcgttaaacgtcgtcggttacttanacctaacgaacgtaaaccgtccggaccgtacggtcccaccggacgtaccgtaccttacacgtattacgtacgacttgacctacaccgtaacggaggccctaagcgaccctacgaccgacggtacgtacggttcgacggacggtgtacgggtcggtaccgtggacgtacgtactactcggtacctaccgtactacgtacgtagtaacgccgtaacgcgttaacggtactacgtttacgttacggtagttaaccggttactttaaggttcttaacaccggtaatacggtacggttaccggactaaccggccggtaaccgggttccgtacggggttacgttaccggaacggtaacgggtaacggtaacggactaaacgggtaccaaccggtcggtacgacggaccgtcgtaaaccgtccgtacgttaccttcggtttaaccctgtttaacccg

SEQ ID NO: 17698 - DNA, 750 bp, Homo sapiens
  misc_feature: GYAE6OF01CDES8.3.3.A03.1.454.CMB.1.raw
  modified_base (461)..(461): a, c, t, g, unknown or other
  misc_feature (461)..(461): n is a, c, g, or t
  modified_base (586)..(586): a, c, t, g, unknown or other
  misc_feature (586)..(586): n is a, c, g, or t
tcagagacgcactccacgaccggtgctcgatttagagagcgtcacgaggggggaggaactgctcagttaggacccaggagggaaccatggaacgccccagctcagcttctcttcctcctgctactctcggcctcccgagactaccaaccggaagtaaatttggtgttcgacactacgtcctccacgtccctacccttcgtttcttttcgtcctaccggaagggggtaaacgacgtaccctaccccttctccgtcggccgaacggggcctagtcgaggtagttcggttacgactagtaccttacttacggccgttacgttacacaaacgaacgtaaaccgtcggaccgacggtccctaccgacggtccttcctactcgttacgtacggtgtccgaccgtacccgtccccggacccgggtacctacggttaccggtcctacccgacggtccgtacggttacgnggtacggtcgtagggtcggtccgtacggacgtacgttcgtcctaccttcaccgactacgtcacgactcggtcgtaggtactacggtacaacgtactcgtagttacttagtttacgtacgtacgtnaacgtactactaagttacgttccggtacggtacggtcggtacgtaccgggtaacggtaacggtaaggtaacggaacgtaacgtaaaccgtacgtaacggtcggtagacccgtacgactacgttccgtacttcgttacttccttaccgtcccttacgcgttaacg

SEQ ID NO: 17699 - DNA, 725 bp, Homo sapiens
  misc_feature: GYAE6OF01AO6PC.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggactcccagactaccaccggagaaattgtgttgacacagtctccagccaccctgtcttgtctcgagggaancgccaccctctcctgcgacggccagtcagagtgttacgcagtcgtacttgcctggtactacgaacgtacgtaaacccgtggacccgtaacggcccttaccccgaggtcccttaccctacaactttccgttaagtcggaacgtttcgacccttaacgtaacccgaaaccggtaccggacccctaaggtccggacctaccgtacccccgaggtccgtaacgttcgacggtacggtccggtagggttcggggtccgtacgggtaactacgttcccgtttaccgcccgtttaccgacctacctaattacggacgttacgccgtaggaccgtactaagggtactttacgttcaccgttagtacttagttgtacgtactaacgtcggtcgtacgcctacggttaccggccgttacgggttcggtaccgtaccgggaacccgtaagggtaccggtaaggtacgtaaccgttaccaaacggttccgtaggtcggtcctacgcctaacttcgtacgtttcgacttcgacccgttccccg

SEQ ID NO: 17700 - DNA, 891 bp, Homo sapiens
  misc_feature: GYAE6OF01CM157.3.3.A03.1.454.CMB.1.raw
  modified_base (148)..(148): a, c, t, g, unknown or other
  misc_feature (148)..(148): n is a, c, g, or t
tcagagacgcactccacgaccggtgctcgatttagagagcgtcacagggggaggaactgctcagttaggacccagagggaaccatggaagccccagctcagcttctcttcctcctgctactcctggcctcccagactaccaccggganaaattgtgttgacacagtcctccacgcccacccttgttctttgtcctaccgaaggggaaacgcgcccaccctctccctgcgacgggccagtcagtgttgttagcagtcttacgtacgcctggtactacaaacgtaacgtaaacccgtcggacccgacggtccctaccccgtaacggtccctttcccgtacctaactttccttaagtacgtaacgtttcgaacccttacgtaacccgaaaaccggaccgggtaccctacggttccggacctaaccgttcccccgagtccccgtaggtttccagggtcggacggtacgggttcgggttacgacgggaacctacggtacctttacccgaccttacctaccggaaccttcgtacccggttagtaccggtaactacggtaccgtacgtaaggttaaacgtttacgtttcgtacctttacgtttaacgttttaacgtttaccgtttaacgacccgtaaaccggttggtacccggttaccgggtaaccgtttaccccggtacccgggtttacccgggttccggggtttaacccgggggttaccccgggtttaacccggggaaaccgggtaccgggttaaaaccgggtaacgggttaaaccggtaaacccgtaacccgtaaaacccggggtacgttccggggttaacggtccctaaccgggccttaacccggttgtttacccgttccgtttacccgtttaccttaccccggtttacccccg

SEQ ID NO: 17701 - DNA, 789 bp, Homo sapiens
  misc_feature: GYAE6OF01CJIX9.3.3.A03.1.454.CMB.1.raw
tcagagacgcactccacgaccggtgctcgatttagagagcgtcacgagggggaggaactgctcagttacggacccaggagggaaccagtggaacgccccagctcagtcttctcttcctcctgctactcgtcgcctaccagactaccgaccggagtaagttgtagttacgacacgtacgtcctccacgtccctaccgttgttcctttcgtaccgtacggaaggggaaacgtccgacccgtacccttccgtaccgtcggaccggtacggaccgtaggtacgaggtaggttacgtacgacgtacgtacgttacgtcgtcgtagtacaaccgaagtaccggaccgtacgaccggtcgtaccctaccgacgtcctacctactacgtactaggtactacgacgtacctaaccgtaccggaaccggtaccggtaccaccgtaccgacccaccgtaccggtacgtacggtacggtcggtacggtacggtacggttacgggtaccggtacggacgtacctaccgttacctaccgtacctacgacctacgtacgtacgaccgtacgtacgtacggtacgttacgttagtacgtttataacgttacgttacttagttacgttactacgtagtaaccggtcgtacgtacgtaccggtccggtacgttccgggtacgtacggaccggtaacgaacgggtaccggaagtaaccgtaccgtaacggtacccgtaaggtccggtaagccgttacctacgtacccgttacgttccgttaccttccgttaccgtccttccggtaccg

SEQ ID NO: 17702 - DNA, 813 bp, Homo sapiens
  misc_feature: GYAE6OF01CIPNA.3.3.A03.1.454.CMB.1.raw
tcagagacgcactccacgaccggtgctcgatttagagagcgtcacagggggaggaactgctcagttaggacccagagggaaccatggaagccccagctcagcttctcttcctctgctactctggcctccagactaccgaccggaagtaaattgtgttgacacagtctccacgccctacccttgttctttcgtcctccgaaggggaaacgcgcccaccctctccgtgcgacgggccagtcagtgtgttagctagtctacttacgctaggtactacgaacgacgtaaccgtggaccgtacggtcctacccgaacggtccttcctactacgttcctagtcgaactcgtacctaacgtacccgaaacggcgggcccacggttcgacctacctcccgacggtccgtaaggttcgacgggttcggacggtgggttcgggggtacgacgggtaactacggttccttaccaccttcgtaaccacctaagttccgaacggtaccgtaaccgtaggtaccgtacgttaaaggtaaacgttttcgtttacgaacgttacgtttactttaacgtttctacggtaacctaaggtcggttcggtaaccggtaacgttacccggtccggggttaccccgttacgggttacccgggttaacccggttaccgggaaccggggtaaaccgggtaaccggtaaaggggttaaccggtaaaacccgtacccggtaaaaccgggttacggttacggggtacctcggtaacccgtaacccgttaacgttcctttacggttaaccgttccctttaaccgtccccgttttaccccgg

SEQ ID NO: 17703 - DNA, 678 bp, Homo sapiens
  misc_feature: GYAE6OF01AI1D5.3.3.A03.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (643)..(643): a, c, t, g, unknown or other
  misc_feature (643)..(643): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccgaccggagaaattgtgttgacacagtctccagccaccctgtctttgctccgagggaaagngccaccctctccgtgcgacgggccagtcagagtgtagcagcttacttacgccgttaggtactacaacgaagtaaacacgtcggacccgtaggccgtacccgngggtaccctcccgtactactcctaagtcggtactcgacacgttaccccgaaggaccgggtaccctaccgtcggaccctaccgtaccccgaacggtacccggttacggttccgaaacgggttcggacgtaaggggttcgggactacggggactacggttacccttacgaaccgttcctaccggaaacctagtaccgtacggtaccgtaccgtacgaccgtccgtaaggtacgtttacgtttacggctagttactttaattgttacgaacaacgtcgacggtcgaaccgtcgtacggtctcggtagtccggtacgacgacggtacaggtaaccgacaccgtacgtncggtcgaccgtcgacgtctagttcgcttctcgtcc

SEQ ID NO: 17704 - DNA, 723 bp, Homo sapiens
  misc_feature: GYAE6OF01B4I9V.3.3.A03.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
tcagagacgcactccacgaccggtgctcgatttagagagcgtcacaggggggaggaactgctcagttaggacccagagggaaccatggaagccccagctcagcttctcttcctcctgctactctggctcccagactaccaccgganaaattgtgttgacacagtctccagccacctgtctttgtctccgaggggaanacgccaccctctcctgcagggccagtcaggagtgttagcagcttacgttagccgtaggtactacaactaacgaaaccctggaccgaacggcctacccgaggtccttccgtacactccttagtgattcgacctactaccaacggacgggcccacgtcgacctaccncccgacgccgtacggttcgaggtcggacgtagggttcgggtacgtacggggaactacgttaccttaccgtactacctacctaaccgtataccggtaagttacccggaccgttaaaggccgtaccggttaagaacggttttagtttccgacgttaacgtttctttaaggttttactacggtaaaccaggtacggtcggtacgaccgtaccgtccgggtaccttcgggttaccgggtaaccggttccgggaaacggaaccggggtaacgtaacgggtaacgaaacccttaccggaaaccgttacggtcgggacgtcgaccactaaccgtcgttcttaaccgttccttaccgctttacccccgg

SEQ ID NO: 17705 - DNA, 718 bp, Homo sapiens
  misc_feature: GYAE6OF01ALURF.3.3.A03.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (348)..(348): a, c, t, g, unknown or other
  misc_feature (348)..(348): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanacgccacctctcctgcagggccagtcagagtnttagcagctacttcgcctggtactcgaacagtaaaccnggccacggctcccgaggcctccnatctattgatgcataccagcggccactcggcactccagtccaggttccaggtcggacnggtgggtccgtagggaacacggtaactttcgaaccttcctaccgaactactacgtaacgtacgaccgtacgacggtaccgttaggtaaacgttagtttttacggaaccgttaagttaccgttaatttaacgtttacgtaccgtaaacgtacggttaccggtacgtaaccgtaaccgtttacccggggtaccccgttagggtacccgggttaaccgggtttaccggggaaacccggtaaaccggggaaccggtaaaacggggtaaccggtaaaaaccggtaacccgtaaaacccgggttaacggtaggttcgggacccgttacgcccgtaaacctacgttaccttaccgtttacgttctaccgttaccccg

SEQ ID NO: 17706 - DNA, 783 bp, Homo sapiens
  misc_feature: GYAE6OF01EI2MT.3.3.A03.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
tcagagacgcactccacgaccggtgctcgatttagagagcgtcacgagggggaggaactgctcagttaggacccagagggaaccatggaagccccagctcagtcttctcttcctcctgctactctggcctcccagactaccgacggagtaaattgtgttgacacgagtcctccacgccctaccttgttctttgtcctacggaaggggaancgccctaccctctccgngcgacggcagtcagtgtgtancagtctatcgcgtagtacacaacgtagaaccgtcggacgacggtcctacccggagtccctactactacttctaagtgagtcgactacgtacccgaacgccggtaccncggtcgaccncctacccggacggtaccgttagggtaccgaggggtcggtacggtacgggggttcggtacgggtacgggtaacctacggtttccctacgtacccgtctaaccgtactacgtcgtaaccggtacgtacgtacgggtacctaggttaacggtaacgttttacgttcggtaacgttttaacgtttacgtttaacgttttagaccccgtaagaaccgggttcggtccggttaccgtaacccggtccggttacccggggttcgtaccggggtccggtttaacccgggacgggaaccggggttaacggaacggggttacgtaaacggtaaccccgtaaccggtaaaccgggtggtacgggtacgtcccgtaaactccttacgtccgtttccgtaggtttcccttacgggtccctttacccccggg

SEQ ID NO: 17707 - DNA, 787 bp, Homo sapiens
  misc_feature: GYAE6OF01CVNVA.3.3.A03.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
  modified_base (657)..(657): a, c, t, g, unknown or other
  misc_feature (657)..(657): n is a, c, g, or t
  modified_base (748)..(748): a, c, t, g, unknown or other
  misc_feature (748)..(748): n is a, c, g, or t
  modified_base (754)..(754): a, c, t, g, unknown or other
  misc_feature (754)..(754): n is a, c, g, or t
  modified_base (764)..(764): a, c, t, g, unknown or other
  misc_feature (764)..(764): n is a, c, g, or t
tcagagacgcactccacgaccggtgctcgatttagagagcgtcacagggggaggaactgctcagttaggacccagagggaaccatggaagccccagctcagcttctcttcctcctgctactctcggcctaccagactaccgaccggtanaaattgtgttagacacagtctacacgtccctacctgtctttgtctaccggaaggggaacncgccctacccttctccgtgaccgacgggcctaaggtctaacggtggttacgtttacgaccgtaacgtaccgtttaacgtttacggtccgttaagggttaactaaccgaaaaccgtaaacggttaaaacccgttcgggacccgaacgggttacccctacccgaaccggttcctacctataacttcgtaatggtaactcgacctaaccgtaccgaacggacccggtacctagtccggtaacctaacgtaccccgtagaaccccgtaggttaccgagggtacggtacccggtaggggttacgggttaccggaacgggaacttaaccggttaccttaaccctccgtacccttaccgaaaccgtaacgttaccggtaacggtaaaccgtaccgtacggaacgttaccgtaaggtaaacgtttgttacgaacgttcttacgttattacgttaanacgtaacgtcgtaccggatccgtaacgtccggtacgttcggtaccggtacgttacgaacgtacggaacgtaggtaacacgtacaacggtgngtacgncctacacgtnttacgtcttacgtcgtctacccg

SEQ ID NO: 17708 - DNA, 565 bp, Homo sapiens
  misc_feature: GYAE6OF02IY2JX.3.3.A03.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
tcagagacgcactccacgaccggtgctcgatttagagagcgtcacgagggggaggaactgctcagttagggcccagagggaaccatggaagccccagctcagcttctcttcctcctgctactctggctcccagataccaccggagaaattgtgttgacacagtctccagcccaccctgtctttgtctccgaggggaaangcccaccctctcctgcagggccagtcagagtgttagcagctacttagcctggtatcaacagaaacctggccaggcctcccaggcctccctcatctatgatgcatcccaacgngggccacgtggcactcccagccaggttcaggtggcaggtgggtcgtgggacagacttcactctcaccatcagtagcctagacgcctagaagtatttgactagtcttagttattgtacaactgtcgtggctaacgtcggtcccgtcgtcggtacgttccggaccgaagggaaccgaagggtacggaactaccgaaccggtaacgtaggtcggacgtcgaccgaccgtacttcgttacgtccttactacttacccg

SEQ ID NO: 17709 - DNA, 505 bp, Homo sapiens
  misc_feature: GYAE6OF02GBR24.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagtattttgctagtcttattattgtcaacagcgtggcaactggccctcgtggtacgttcggccgaaggaccaaggtggaatcgaaccgaactgtggctgcaccgatctgtcttcattccc

SEQ ID NO: 17710 - DNA, 535 bp, Homo sapiens
  misc_feature: GYAE6OF02G0DBB.3.3.A03.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaacgngggccactggcactcccagccaggttcagtggcagtgggtctgggacagacttcactctcaccatcgagtacgcctagacgcctagaagtatttgctagtcttattattgtacaactagtcgtgacaacgtcggccctcggtcggtaccgttcgaccgaaggaccgaaggtacggaatcgaaccggactaggtacggctcgccactacgtcctagtccttactacttcccg

SEQ ID NO: 17711 - DNA, 513 bp, Homo sapiens
  misc_feature: GYAE6OF02JCWN5.3.3.A03.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaacngggccactggcatcccagccaggttcagtgcagtggtctgggacaggacttcactctcaccatcagtagcctagagcctgaagtatttgctagtctattattgtcaacagcgtggcaacgtggccctcgtggtaccgttcggccgaagggaccaagggtaggaactacgaaccggaactggtaggctgcacctatcctgtcttcattccg

SEQ ID NO: 17712 - DNA, 546 bp, Homo sapiens
  misc_feature: GYAE6OF02H9CEF.3.3.A03.1.454.CMB.1.raw
  modified_base (366)..(366): a, c, t, g, unknown or other
  misc_feature (366)..(366): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcactcccagccaggttcagtggcagtgggtctgggacagacttcactctcacntcagtagcctagagcctagaagtattttgctagttcttaattattgtactaacagtcgtggctaacgtcggtcccgtcgtggtaccggttcggccgaaacgggaccgaagggtaggaacgtccgaaaccggtaacgtacggtacggtcgtcgacgtaccgatccttgtcttcacttcccg

SEQ ID NO: 17713 - DNA, 595 bp, Homo sapiens
  misc_feature: GYAE6OF02HVNUU.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagcagctacttagcctggtatcaacagaaacctggccaggctcccaggctcctcatctatgatgcatccaacagggccacgtggccatcccagccaggttcagtcggcagtgggtctgggacagacttcactctcacatcagtgctagacgcctagattagtttcgactacgttacttaattcgtttacgtactaacgtcgtcggtacggactaacggtccggtcccgttcggtacggtaccggttaccggaaccggtaacggaaccgtaagggtaacgtaacgtaccggaaaccggtaacgttacggtacggtacgtaccgaccgtactacgttaccgttacgttaccgttacgtaccgttccccg

SEQ ID NO: 17714 - DNA, 555 bp, Homo sapiens
  misc_feature: GYAE6OF02HHLZR.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagacgcctagaagtattttgctagtctatttattgtacaacagcggtggacaacgtcggtccctcggtcggtaccgttccggaccgaacgggaccgtaagggtaggaacgtccgaaccggaacgtacggtacggtaccgtcgaccgtaccgacgttccgttgtcctttactacttcccg

SEQ ID NO: 17715 - DNA, 525 bp, Homo sapiens
  misc_feature: GYAE6OF02G3O6B.3.3.A03.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtatcaacagaaacctggccaggctcccaggctcctcatctatgatgcatccaacngggccactggcatcccagccaggttcagtggcagtgggtctgggacagacttcactctcaccatcagtacgcctagacgcctgaagtatttgctagtctattattgtacaacagcgtggcaacgtcggccctcgtcggacgttcggaccgaacggaaccgaaggtaggaactacgaaccggaacgtacggtaggctagacacgactctgtcttctattcccg

SEQ ID NO: 17716 - DNA, 525 bp, Homo sapiens
  misc_feature: GYAE6OF02GYS03.3.3.A03.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggctcctcatctatgatgcatccaacngggccactggcatcccagccaggttcagtggcagtgggtctgggacaggacttcactcncaccatcagtagactagagcctgaagtattttgctagtcttattattgtacaacagcgtggcaactcggcccgtcgtcggtacgttcggaccgaacgggaaccgaagggtacgaagtacgaaccggaactagtggcgtgaccaccatctcgtcttctattcccg

SEQ ID NO: 17717 - DNA, 611 bp, Homo sapiens
  misc_feature: GYAE6OF02FZTQZ.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacaggacttcactctcaccatcagtacgcctagacgcctgaagtattttgctagttcttaatttattgttacaacagtcgtggactaacgtcgggtccctcggttcgggtaaccggtttccgggaacccgtaaacggggaacccgtaaacggggtacgggtaaacgtaccgaaacccggtaaaccggttacggttacggggtaccttacgggacctaacccgtacgttacccgttaggtttcccgtttaccgtactttaccccg

SEQ ID NO: 17718 - DNA, 534 bp, Homo sapiens
  misc_feature: GYAE6OF02GE8Z8.3.3.A03.1.454.CMB.1.raw
  modified_base (356)..(356): a, c, t, g, unknown or other
  misc_feature (356)..(356): n is a, c, g, or t
tcagagacgcactccacgaccggtgctcgatttagagagcgtcacaggggggaggaactgcctcagtttagggacccagagggaacctatggaagccccagctcagcttctcttcctcctgctactctggctcccagataccaccggagaaatttgtgttgacacagtctccagccaccctgtctttgtctccaggggaaagagccaccctcgtcctgcagggccaggtcagagtgttagcagctacttagcctggtatcaacagaaacctggccaggctcccaggctcctcatctatgatgcatccgaacagggtccaactaggcatcccagccaggttcagtggcagtgggtcngggacagactcactctcacatcagtagacctagagcctgaagtattttgactagtcttattaattgtacaacagcgtggactaactcggccctcgtggtacgttcggaccaacgggaccgaaggtagaatacgaaccgtaactaggtcggcttacgacacatccgtgtcttcattccg

SEQ ID NO: 17719 - DNA, 576 bp, Homo sapiens
  misc_feature: GYAE6OF02IT72S.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggctcctcatctatgatgcatccaacgagggccactggcactcccagccaggttcagtggcaggtgggtctgggacagacttcactctcacctatcagtacgcctagacgcctagaagtagttttgctagtcttaatttatttagtacaactacgcggtggactaacgttcgggcccgttcggtcgggtacgttccgggaccgaaacgggtaaccgaagggtacggaacgtaccgaaaccggtaacgtacggtcggtaccgtacgaccgaccgtagtccgttcgtctttacacgttacccg

SEQ ID NO: 17720 - DNA, 529 bp, Homo sapiens
  misc_feature: GYAE6OF02HBBG6.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggctcctcatctatgatgcatccaacgacgggccactggccactccccagccaggttcaggtggcaggtgggtctgggacaggacttcactctcaccatcagtagcctagacgcctagaagtatttgctagttcttattagttgtacaacagtcgtggacaacgtcgccctggtcggtacgttcggaccgaaggaccgtaaggtaggaactacgaaccgaacgtgtggcgtgacactatcgtgtcttcattccg

SEQ ID NO: 17721 - DNA, 551 bp, Homo sapiens
  misc_feature: GYAE6OF02G9UU9.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtatcaacagaaacctggccaggctcccaggctcctcatctatgatgcatccaacacgggccacgtggcatcccagccaggttcagtggcaggtggtctgggacagacttcactctcacctatcagtacgcctagacgcctagaagtatttgctagtcttattattgtacaacagcgtaggctaacgtcggccctcggtcggtaccgttcggaccgaaagggaccgtaagggtacggaactacgaaaccggtaacgtacggtacggacctagacctacctacgtcttacgtccttcattccccg

SEQ ID NO: 17722 - DNA, 506 bp, Homo sapiens
  misc_feature: GYAE6OF02GTNFJ.3.3.A03.1.454.CMB.1.raw
  modified_base (409)..(409): a, c, t, g, unknown or other
  misc_feature (409)..(409): n is a, c, g, or t
  modified_base (502)..(502): a, c, t, g, unknown or other
  misc_feature (502)..(502): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtgcagtgggtctgggacagacttcactctcaccatcagtagcctagacgcctagaagattttgctagtctatttattntcaacagcgtgcaactggccctcgtggacgttcggaccgaagggacaagggtagaagtcgaaccgaactgtcggctcgcaccatctgtcttcnttcc

SEQ ID NO: 17723 - DNA, 499 bp, Homo sapiens
  misc_feature: GYAE6OF02IOCYD.3.3.A03.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaanagggccactgcatcccagccaggttcagtgcagtgggtctgggacagacttcactctcaccatcagtacgcctagagctgaagtatttgctagtctattattgtcaacagcgtgcaatcggcctcgtggtacgtcgcgaaggaccgagtaggaactacaaccggaactacgtggctgcacactcgtgtcttcatccg

SEQ ID NO: 17724 - DNA, 689 bp, Homo sapiens
  misc_feature: GYAE6OF02FX8Y3.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaacctggccaggcctccaggcctcctcatctatgatcgcactaccaacgacgggccaacgtgggccaacgtccccgaaggtccccgtaaggtttccaaggttcgggaccgtaagggttcgggggttcctagggggaacctaggtaacctttccgaaccttccttaccaacccgtatccgaagtacgtacctaggacgtccgtaggtaagttagttttcgactagttacttaattagttacgtactaacgtacgtacgtacggactaaccgttcggtcccgttacggtcgggttaccggttccgggacccgtaaacggggtaacccgtaacggggtacggtaaacgttaccgaaacccggtaacgttacggttacgggtacgtacgaccgtaaccgtacgttaccgttacgtttacctttaccgtacttccccg

SEQ ID NO: 17725 - DNA, 567 bp, Homo sapiens
  misc_feature: GYAE6OF02IKNKS.3.3.A03.1.454.CMB.1.raw
  modified_base (196)..(196): a, c, t, g, unknown or other
  misc_feature (196)..(196): n is a, c, g, or t
  modified_base (427)..(427): a, c, t, g, unknown or other
  misc_feature (427)..(427): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggcctccaggcctcctcatctatgatgacatccaagcgggccagtggcactcccagccaggttcagtggcaggtgggtctgggacagacttcactctcacctatcagtacgcctaagcgcctagaagttatttcgctagtcttaattattgtactaacgngtcgtggacaacgtcggtaccgttcgtcggtacgttcgaccgaaacgggtaccgaagggtacggaaacgtaccgaaccggtacgtaggtacggtcgtacgaccgtaccgtacgttcgttacgttacttcctacttccccg

SEQ ID NO: 17726 - DNA, 548 bp, Homo sapiens
  misc_feature: GYAE6OF02IDF5F.3.3.A03.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctccaggctcctcatctatgatgctatccaacngggccactggcaactcccagccaggttcaggtggctaggtcgggtctgggacaggacttcaactctcaccatcagtagcctagacgctagaatatttgcagttctatttattgtacaacngacgtggactaacgtcggccctcgtcggtacgttcggacctaaagggaccgaagggtggaaactacgaaaccgaactcggtacggcgttcgacctaccagtaccttcggtcttaccgtattcccg

SEQ ID NO: 17727 - DNA, 542 bp, Homo sapiens
  misc_feature: GYAE6OF02FVT71.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctacgaggggaaangccaccctctcctgcagggccagtcagagtgttagcagctacttagcctggtatcaacagaaacctggccaggctcccaggctcctcatctatgatgcatccaacgagggccaagtggacagtccccagcccaggttcaggtggcaggtgggtctaggggacacggtcttcgactctcaccatcagtagcctagactcctagtaagtattttgctagtcttatttatgtactaacagtcgtggacacgtcgacctggtcggacgttccggacaaggcgtaaggtggaactcgaaccgtaactggacggtctcgactacctacttcgtacgttcttcctattcccg

SEQ ID NO: 17728 - DNA, 953 bp, Homo sapiens
  misc_feature: GYAE6OF02FX8WS.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccacccctctcctgcgacggccagtcagtagtgttagcagtcttacgttacgccgttaggtactaccaaacgaacgtaaaccgtcggaccgaacggtcccctaccccggacggtccccttacccctactacttaccgttaagtcggtaacgttcgacctaccgtaaccccgaaacgggaccggggacccctaacggtccgggaccctaaccgttacccccgacggtaccccggttaacgggtttaccgaacggggttccgggtaccggtagggggtttccgggggttaccggttaacggggggaaacctaacgggtttaaccctttacccgtaaccgtttaccccgtaaccctaaacccgttaacgtttacccggaaacggtttaacccggtaacccgttaaacgggtaacccggttaccccgttaaagggttaaaacgttttacggtttttacggaccgtttaaacggtttactttttaaagttttaacgtttaccgttaaccctaaaaccggttcgggtaccgggttaacgggtaacccgttaaaccgggttcccgggttacccgtttacggggtttaccgggttacccgggtttaacccggggaacccggtaaaacggggtaacccggttaaacggggttaacggtaaaccgtaacccggtaaacccggttaacggttacgggtacggtaccgtacgtaacccgtaccgttacttacccgttcggttacctttaccgtacctttacccccgg

SEQ ID NO: 17729 - DNA, 548 bp, Homo sapiens
  misc_feature: GYAE6OF02GFADS.3.3.A03.1.454.CMB.1.raw
  modified_base (420)..(420): a, c, t, g, unknown or other
  misc_feature (420)..(420): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctccaggctcctcatctatgatgcatccaacagggccactggcatcccagccaggttcagtggcaggtgggtctgggacagacttcactctcacatcagtacgcctagagcctagaagtattttgctagttacttattattgtacaacgngcgtggcaagtcggccctggtcggtacgttcggaccgaagggaccaagggtacggaactacgaacccggtaatacggtacggaccgtacgaccacctacgtccgttcgttacctttactacgttcccg

SEQ ID NO: 17730 - DNA, 510 bp, Homo sapiens
  misc_feature: GYAE6OF02FHOYF.3.3.A03.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaacctggccaggctcccaggctcctcatccatggtncatccaanagggccacgtggcatcccaagacaggttcaggtggcaggtgggtctgggaacagtaccttcactctacaccatcagccagactggacgcctagaacgtactttgacctagtttatacttgtctgctagtatggttacttcacttcttgtctaagtttcggcgcggacaggtgagatacgaaacgtactgtggctgcacatctgtctctac

SEQ ID NO: 17731 - DNA, 798 bp, Homo sapiens
  misc_feature: GYAE6OF02HNCLC.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanacgccaccctctcctgcgacgggccagtcagagtgttagcagtctacttagcctggtatcaacagtaaacctggaccaggcctcccgaggcctcctcatctatgatgcactccaacgcggacctagtcggacctacgtcccgagcccgtaaggttccaaggtcggactaggggttcggggtacgtacggggtacaacggtacctttccgaaccttcctaccgtaaccctagttcccgtaaggttaaccgtaccgtaacggtaaccggtaccgttaaggtaaacgttacgttttacggacgttaacggtttactttaacgttttaacgtttacgttaacgtaaaccggtaacggtaccggtacgggtaacccgtaaaccggtttccgggtaccccgtttaccgggttaaccggggttaacccgggtttaccgggtaaacccgggtaaaccggggtaacccggtaaaggggttaaccgggtaaaacccgttaccgggtaaaacccggtaaccggttacgggttaccggtaccggttaacccgtacccgtaacccggttacgttccggttaccgtttaccgtttaccctacccgtttacccccg

SEQ ID NO: 17732 - DNA, 817 bp, Homo sapiens
  misc_feature: GYAE6OF02I0LXM.3.3.A03.1.454.CMB.1.raw
  modified_base (635)..(635): a, c, t, g, unknown or other
  misc_feature (635)..(635): n is a, c, g, or t
  modified_base (651)..(651): a, c, t, g, unknown or other
  misc_feature (651)..(651): n is a, c, g, or t
tcagagacgcactccacgaccggtgctcgatttagagagcgtcacaggagagaaggggctgggcctcaggaagcagcatcggaggtgcctcagccatggcatggatccctctcttcctcggcgtccttgcttactgcacaggatccgtggccttcctatgagcgtacgtactacgccgaccctacctacggtacggttccggttccggttccccgtacccgggtacggaccgaacggaccgaccgtaccccggtacccgtaaccctaccgtaccgtccttacggtacggtaagttaagttttagggttaggtaactaaaacgtaaattcgtccgttccctttcggtttacgttacgacgtaccgtaaccgttaccctaaccggaccgtaccgttaccccggttcccgtggtccgttaccggttccggtacttaccgtttaccgtaacggaacttacccgaaacgaccggtcccccgtacccgtacgggtaacgtaccccttacggacggtacgtaaccgttcttccgttcggtccgttaccctaacccgttacgtcgggtaaccgtaacaccgtaccgtaccttacgtccgtaaccacttaccgtacggaccgggacccgacgtagtactacggnggtacgacgggtaccncggttaatacgtttaacgtacggtccgtaggacggggtccgggaagaccgcgggtccgggactaacctcgtaacgttagttccgggacgggaaccgggttacgaacctcggtacccgtaccggtaccgtacggtaccgtaccggacccggtacggccgttccccgg

SEQ ID NO: 17733 - DNA, 694 bp, Homo sapiens
  misc_feature: GYAE6OF02JFIMO.3.3.A03.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtcttgtctccaggggaanagccacctctcctgcaggccagtcagagtgttagcagctacttagcctggtatcaananaaacctggccaggctccaggctcctcatctatcgatcgacatccaacgacgggccacgtcggacctaactcccgagccagggttccagtggcaggttgggtcctagggaaccagaccttacacgttctaccaccgtatacgagtacgccttaagcgtacctagtaagtagtttcggactacgttacttagttagtttacgtactaaacgtcgtacggtacggtacgtaaccgttcgggtaccccgttacgggttacgggtaccgtttaacccgggtaccgtaaaccgggtaacccggtaagggttaaccggtaacgtaacccggtaaacccgggtaaccggttacggttaaccgggtcccggttaaacggtcccgttaaacccggtaacgtttcccggttaaccggtttaccccgtttacccgtacggttttaacccccgg

SEQ ID NO: 17734 - DNA, 627 bp, Homo sapiens
  misc_feature: GYAE6OF02FNDWO.3.3.A03.1.454.CMB.1.raw
  modified_base (197)..(197): a, c, t, g, unknown or other
  misc_feature (197)..(197): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtatcaacagaaacctggccaggctcccaggctcctcatctatgatgcatcccaaacacggggccacgtgggaccactccccgaagccctaagggttccaggttcggaccgtagggttgggtcgtggggacaggtacttacacttctacaccatacgagtacgccgtaaggacgtaccgtaggaaagttacttttacggactaagttacttaatttacgttagttaccaacgtaggtccgtaggacctaacgtcggtacccgtcgggtcggtacggttccggaccgtaaacgggaccgtaagggtacgaacgttaccgaaccggtaacgtggtacggtctacgaccgtaccagttccgtacggttcttacgacttcccg

SEQ ID NO: 17735 - DNA, 540 bp, Homo sapiens
  misc_feature: GYAE6OF02FIGB1.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggctcctcatctatgatgcatccaacagggccatggcatcccagccaggttcagtggcaggtgggtctgggacagtacttcactctcacctatcagtagcctagagcgtgaagtattttgctagtcttattattgttacaactagtcgtggacaacgtcggtcccgtcgtcggtacgttccggaccgaacgggaccgaaggtaggtaacgtacgaaccgaaacgtagtacggcgtagactaccacgtacctgtcttctattcccg

SEQ ID NO: 17736 - DNA, 695 bp, Homo sapiens
  misc_feature: GYAE6OF02FIHZC.3.3.A03.1.454.CMB.1.raw
  modified_base (199)..(199): a, c, t, g, unknown or other
  misc_feature (199)..(199): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagactaccaccggagaaattgtgttgacacagtctccagcccaccctgtctttgtctccgaggggaaangccaccctctcctgcagggccagtccagagtgttacgcagtctacttagccttggtactccaacacgaaaccctggcccaggcctcccaggcctcctcattcctatcggactgacactaccgaacgcgggccacgtcggaccactccccgagtcccgtaggttccgaggttcggacgtagggttcggtccgtacgggaacctacggtaccttacaccttcctaccaccctataccgtaacggtaccgtaccgtaggtaccgtaccgtaaggttaacgttacgttttacggacttaacgttacttaagtttaccgtacgttaaccaacgtcgggtccgtacggaaccgtacggtccggtacccgttaggtaaccggtaccgttaccggaaccgtaaacgggaccgtaacgggtaacgaaccgtaccgaaccggtacgtcggaccgtacctaccgacctacgtacgttaccgttctacccttactacccgttccccgg

SEQ ID NO: 17737 - DNA, 816 bp, Homo sapiens
  misc_feature: GYAE6OF02HIP7Q.3.3.A03.1.454.CMB.1.raw
  modified_base (201)..(201): a, c, t, g, unknown or other
  misc_feature (201)..(201): n is a, c, g, or t
tcagagacgcactccacgaccggtgctcgatttagagagcgtcacagggggaggaactagctccagttaggacccagacgggaaccatggaagccccagccgcagcttctcctcctcctgctactctggtctcccagataccactaggagaagtagttctgatgcagtctcaggcaccctgtctgtgtctccaggggaaanagccacggcctctccgtggtaagggccagtcagagtcgtcagtacattaaatttaggcttaggtaaccaactagtaaaccgtggacccaaggcctcccccgaggcctaccgtcaatttcgaagtggttcggactagtacctaaacggcgggcctaagtcggacttagttcccaagccgtaaggtttcaaggttggactaaggttacggattaggcggggaactagtacctttaccgtaacttccgtaccaaccctaagtaccgtaacgtacctaaacgttaccgtacggtaccgttaacgttaccgttaggtaaaacgtttagttttacggtaacgttttaaacggtttttacgtttttaccgttacggttaacctaagttacccgttaaacggtttttaaacccgtacccggtttaccgggtaacccgtttagggttttaaaccggttttttaccgggaaccggttaaccgggggtaacccgtaaagggttccggttaagggtaaccggttaaccgttaaaccggtaaaacccggttaaccggtttacggtaaccggtttaccgttacggtaacccgttaacccggttacgttaccggtttaccgtttaacccg

SEQ ID NO: 17738 - DNA, 659 bp, Homo sapiens
  misc_feature: GYAE6OF02GDU4T.3.3.A03.1.454.CMB.1.raw
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagcccaccctgtctttgctccgaggggaaagagcccaccctctcctgcgagggccagtccagagtgttagcagctacttagcctggtatcaacagaacctggccaggctccaggcctccncatctatgatgcataccaacgngggccactggccactcccgagcctaggttcaggtcggactaggtcggggtctacggggaactacggtacttccgaccgttctaccgaacctacgtaccgtaaggtacgtacccgtaaggaccgtaccgttacggaaaggttacgttttaggaccttaagttactttaagtttacgtttacgttaccaacgtacggtcgttacggacgtaacggtcggcccgttacggtacgggtaccggttccggaccgtaacgggaccgtaagggtacggtaacgtaccgaaaccggtaacggtcggtacgggtaccgtcgaccaccgtacgttcctagttaccgttcctacgttacccg

SEQ ID NO: 17739 - DNA, 533 bp, Homo sapiens
  misc_feature: GYAE6OF02FIT1R.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtatcaacagaaacctggccaggctcccaggctcctcatctatgatgcatccaacagggccactggcatccccagccaggttcagtggcaggtgggtctggggacaggacttcacgtctcaccatcagtacgcctagacgcctgaagtattttgctagtcttattattgtacaacagtcgtggctacgtggccctcgtcggtacgttcgggaccaagggtaccaagggtcgaactcgaaccggtaactggtacggacttcgacaccgatcgtgtcttcacttcccg

SEQ ID NO: 17740 - DNA, 710 bp, Homo sapiens
  misc_feature: GYAE6OF02GPKJN.3.3.A03.1.454.CMB.1.raw
  modified_base (202)..(202): a, c, t, g, unknown or other
  misc_feature (202)..(202): n is a, c, g, or t
tcagagacgcactccacgaccggtgctcgatttagagagcgtcacaggagagaaggggctgggcctcaggaagcagcatcggagtgcctcagccatggcatggatccctctcttcctcggcgtccttgcttactgcacaggatccgtggcctcctatgagctgactcagccaccctcagtgtccgtgtccccagggcagacngccaccgtcacctgactctggagataatttgggatacaaaatatgcttcctggtttcagcagactccgaggccacgtcccctgtcgctggtcatctttacaagtataccaagccgcccctgacgggtactcccgtagacgcgtattcctcgtcggtcctaccgtaacttcgtacggggaaacctaccgaaccgtccctaaccttaccttaccggaaaccccgtaagttcccgaacgggtacccggggaaacccccgtagggtacccttaaggttacgggtacgttacgggacgggttaccttacgtaaacctttacgtttaaccgttcggtaaccgtacggggtaccggttacgggaccgtaacgggccgggtaccgaccgtaaccgtacccgtaagttaccggtttacgggggaccgggttaaaccgggaacccgtaaggtcccgttaacggtacccggttaccggttaaacgggtcccgtaacggacccccgtaaagggttccccg

SEQ ID NO: 17741 - DNA, 710 bp, Homo sapiens
  misc_feature: GYAE6OF02H44TU.3.3.A03.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
tcagagacgcactccacgaccggtgctcgatttagagagcgtcacaggagagaaggggctgggcctcaggaagcagcatcggaggtgcctcagccatggcatggatccctctcttcctcggcgtccttgcttactgcacaggatccgtggcctcctatganctgactcagccaccctnagtgtccgtgtccccagggcagacagccaccgtcacctgctctggagattaagttgggactacaaatatgtcttcctggtttacaggcagtactccaggcctagtcccctagtcgcgtcggtctacttctttacgaaagactaacccagtaccgaccccttacgacgggtactccctagacgcgtaacttcgtactcggaccttcccaacgtcgtacgggaacaccgtacgacctacgtacctcgaaccccgtataccgaacggtaccggggaacccctaagggtccgttaagtacgggtaacttagacgggttacctaggtaaccttagtttaacctcggttaccgtagggtaccggttacggggaaccgaacgggtcccggggtacggtacccgtaacgttacccgtaaagttaccgtttacggggccggggttaaaccgggtacccgaaagggttcccctacgggtaacccgttacccggttaaccggttacccggaaacccggtacccccggaaagggttccccccgg

SEQ ID NO: 17742 - DNA, 558 bp, Homo sapiens
  misc_feature: GYAE6OF02FQT9P.3.3.A03.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggctcctnatctatgatgcatccaacagggccacgtggcatcccagccaggttcagtggcaggtgggtctgggacagtcttcactctcaccatcagtacgcctagacgctagtaagtattttgctagtcttattattgtacaactagcgtggactaacgtcggtccctcgtcggtacggttccggaccgaacgggaaccgtaacgggtaggaacgtacgaaccggtaacgtacggtacggtcgtacgaccgtaccgacgttccgttcgtcttaccacttcccg

SEQ ID NO: 17743 - DNA, 699 bp, Homo sapiens
  misc_feature: GYAE6OF02I5YIJ.3.3.A03.1.454.CMB.1.raw
  modified_base (286)..(286): a, c, t, g, unknown or other
  misc_feature (286)..(286): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggcctcccgaggcctccnactctatgactgacataccaaacgacgggccacgtcggactactaccccgagcccgtaggttccaggtcggacgtagggtcggggtactacgggggaactacggtactttaccacgttcctacccaaccagttaccgaagttacgaccctaaggacgtaccttaggaaacgttattttacggactacggttacgttaatttaacgtttcgtaccgtaaacgtacggtccggtacgggacctaaacggtccggtcccgttacgggtacgggtaccggtttaccgggaaccggtaaacggggaaaccgtaaacgggtacggtaaacgtaaccggtaaaccggtaaacggttacggtcggtaaccgtcgaaccgtacgtacgttaccgttacggtaccttccgtactttaccccgg

SEQ ID NO: 17744 - DNA, 638 bp, Homo sapiens
  misc_feature: GYAE6OF02HFWQR.3.3.A03.1.454.CMB.1.raw
  modified_base (303)..(303): a, c, t, g, unknown or other
  misc_feature (303)..(303): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgagggaagacgccctacctctcctgcgacgggccagtcagagttgttagctagctagttagcctaggtaccagccagtattcgtgccaggcctcccagctcctcactctatcggcncactccgacccgggcctacgtggtacctcccagcctaggttccaggtcggcgtaggtggggtacctcgggactaggtacgttccacgttcctacgtacccagtacaacgtcacgccgtaggacgtcgtagaacgtctacgtacgtacttaagtttacgttacgtagtacacgtactagttacttaacgttcggtacggtaccggttacggtaccggtttccggaaccgtaacgggaacccgtaaagggtaagtaaactacgtaaacgacgttacggtggaaccttcggaccctaacgtacgtcttacgttcttacgtcgttaccttcccgtaccg

SEQ ID NO: 17745 - DNA, 658 bp, Homo sapiens
  misc_feature: GYAE6OF02FQN1C.3.3.A03.1.454.CMB.1.raw
tcagagacgcactccacgaccggtgctcgatttagagagcgtcacaggagagaaggggctgggcctcgaggaagcagcatcggaggtgcctcagccatggcagtggatccctctcttcctcggcgtccttgcttactgcacaggactccgtggcctcctatgagctgactcagccaccctcagtgtccgtgtccccagggcagacagccaccgtcacctgctctggagataattgggatacaaaatatgcttcctggtttcagtcagactccgaggccacgtcccctgtgcgtggtctagttctttacaagtactaaccgaaacgtcccgcccccttcgacggggtacctccccgtggacgtacgtactttccgtcgtcggtcctaccctaaacgtcgtaacggggaaccaacgtacgaccctacgtctacgtacccatccgaacggccgggaaccccgtagggacctaagtcggtaagtacggacggaccgttagtaaccttacttacgtagtccggtagggtcggttacgggacgtacgggtccggacggtaccaaccgtaccgtaagtacggtccggggaaccgggaacgggaaccgtaacggtccgtaacggacccgttaccgtagggaccctaccggacccggaggtccccgg

SEQ ID NO: 17746 - DNA, 706 bp, Homo sapiens
  misc_feature: GYAE6OF02I88IE.3.3.A03.1.454.CMB.1.raw
  modified_base (196)..(196): a, c, t, g, unknown or other
  misc_feature (196)..(196): n is a, c, g, or t
  modified_base (470)..(470): a, c, t, g, unknown or other
  misc_feature (470)..(470): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaanagccaccctctcctgcagggccagtcagagttgttagcagctacttagcctggtatcaacagaaacctggccaggcctcccgaggtcctcctcattctatgatgcactaccgaacgcgggtccacgtcgacctactcccacgccgtaggttcaggttcggcgtagggttcggggtccgtaggggtaccaacgggtacctttaccgaccttcctaccgtaaccctattaccgaacggtacgtaccctaggtaacggtacccgtaggtaaacgttnttttacggacttacgtttactttagttttaagtttcgttacctaaacgtcggtaccggtacggtaccgaaccggttcccgggtacccgtttccgggttacgggtacccggttccggaccggtaaacgggtaacccgtaaggggtaccggtaacttaccggaaccgtaacggtacgtaccgggacttcggaaccgtaccgtactttccggttcgttacccttacctcgtttaccccc

SEQ ID NO: 17747 - DNA, 686 bp, Homo sapiens
  misc_feature: GYAE6OF02H3EQJ.3.3.A03.1.454.CMB.1.raw
  modified_base (200)..(200): a, c, t, g, unknown or other
  misc_feature (200)..(200): n is a, c, g, or t
  modified_base (635)..(635): a, c, t, g, unknown or other
  misc_feature (635)..(635): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtcctccagccacccttgtcctttgtcctcgaaggggaanagccaccctctcctgcagggccagtcagagtgtagcagctacttagcctaggtatcaaaaccgagaaaaccccgtggacccgaagggcctacccgacggccttccctactaacttctaagttggaattaggaccaatacccaacggagggtaccccagtcggacaactcccgacgtacccgaggttcaagtacggctaaggggtggttcgaaggggacctagtaacttccgaacttccgtacaaacccgtattacccgaaggtacgaccgttaacggacgtaccgtaaggtaacgttagtttacgaactggttaccttaagtttacttacgtacgaactagttcgaacggtaccaacgttcggaccccgtacgtacgggtaccgttaccgggaccgaaacggtaccgtaaaggacggtaactaccgaaaccggtntaacggtagccgtagacctacgtaactccgttacgttcttccagttccccg

SEQ ID NO: 17748 - DNA, 601 bp, Homo sapiens
  misc_feature: GYAE6OF02FOX3C.3.3.A03.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtatcaacagaaacctggccaggctcccaggcctcctcatctatgatgctatccaacgngggccacgtggcactcccagccctaggttcagtggcaggtgggtacngggacagtacttcacttctacacctntacgacgtacgtcctagacgcctaggaagttactttagactagttacttaatttagttacgtactaaacgtagtacgtacgggtaccacgttcggtcccgttacggttcggtaccggttcggaccgtaaacgggaccgtaagggtacgtaacgtaccgtaaccgtaacgtggtacggtacgtacgaccgtaccgtacgttccgtacgtccttacgtattcccg

SEQ ID NO: 17749 - DNA, 582 bp, Homo sapiens
  misc_feature: GYAE6OF02F5BYN.3.3.A03.1.454.CMB.1.raw
  modified_base (197)..(197): a, c, t, g, unknown or other
  misc_feature (197)..(197): n is a, c, g, or t
  modified_base (367)..(367): a, c, t, g, unknown or other
  misc_feature (367)..(367): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtatcaacagaaacctggccaggctcccaggctcctcatctatgatgcatccaacacgggccacgtgggccactccccagccgaggttccaggtggctaggtggggtcgtggggactagngttacactctacaccatcagcacgccctagcgtaggttctagaagtattttgacttacttttatttctgtcagtactaattaactaattaacgtggacccgttcgtcgggttaccgttcggggacccggggaacgtaagggacgggtagtacgtaaccgtaaacgaacgtggtacggtctacggtaccaccggtacttcgtgttccgttactacg

SEQ ID NO: 17750 - DNA, 746 bp, Homo sapiens
  misc_feature: GYAE6OF02GEQ8D.3.3.A03.1.454.CMB.1.raw
  modified_base (196)..(196): a, c, t, g, unknown or other
  misc_feature (196)..(196): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccacctgtctttgtctccgaggggaaanacgccaccctctcctgcagggccagtcagagtgttagcagctacttagccgtggtaatccaaacagaaaccgtggccacggctacccgaggcctcctcatctatgatcgcacgtccaacgacgggcctacgtcggacctactcccgaggacctaggttcagggtcggacgtagggtcggggtcgtacgggggactaacggtaccttaccgtaccttacctaccgtaaccctacgttacgacggttaaccgtacccgtaacggaacggtaccgttaacggtaaacgttaacgttttcgtactaacggttactttaagtttacgtttacgttacaaacgtagtccggttaagggtacctaacgttccgggtaccctttcggggtaccggttaccgggttacccgggaaccgtaaaccggggtaaccgggaacgggttaacgggtaaaccgtaacccggtaaaccggtaacgggttaacggttacgggaccgttacgaacccggtaccttaacggttccgttcgtttcccgtttaacgtccgtttaaccccgg

SEQ ID NO: 17751 - DNA, 709 bp, Homo sapiens
  misc_feature: GYAE6OF02FO4JG.3.3.A03.1.454.CMB.1.raw
  modified_base (195)..(195): a, c, t, g, unknown or other
  misc_feature (195)..(195): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgctccaggggaaanagccaccctctcctgcgaggccagtcagagttgttagcagcttacgttacgcctaggtactacaacaacgaaaccgtcggaccacggcctacccgaggtcctccgtcattctatgatcgacactaccgaacgacgggaccctaggtcggaccacctacccgacgtacccgtaggttacgacggtcggacgtagggttcggggtccaggggacctacggtaccttaccacctctacccaacctacttacgagtacgtaccgtagaccgtaccttaggtaacgtttgttttacgacgttagtttactttaactttaacgtttcgtactaacgtaggtcggttacggaccgtaacggttccggtaccccgttacggggttaccggtaccgggttacccgggaaccggtaaacgggtaccgtaaggggtaacggtaacgttacccgaaacggtacgttcggtacgaccgtacgaccgtaccgtacttccgttacgttaccttaccgtccgttaccccg

SEQ ID NO: 17752 - DNA, 666 bp, Homo sapiens
  misc_feature: GYAE6OF02HPYOH.3.3.A03.1.454.CMB.1.raw
  modified_base (194)..(194): a, c, t, g, unknown or other
  misc_feature (194)..(194): n is a, c, g, or t
  modified_base (658)..(658): a, c, t, g, unknown or other
  misc_feature (658)..(658): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgtgacacagtctccagccaccctgtctttgctcgaggggaaanagccaccctctcctgcaggccagtcagagtgttagcagctacttagcctaggtactacgaacacgaaaccgtggaccgaggcgtacccgaaggcctcctacacttacctatacgagtacgactaactaccgaaacgacgggtacccaacgtcggacacgtaccccagccgtaacggttcgaaggtcggtacgtaagggtggggttccgtacggggaactacggttaccttcgaaccttcctaccaaccgatttccgaagtacgcccgttaaggacgtccgtaggtaaagttcgtttacgacgtaacgtttacttagtttaacgttcgtaactaaacgacggtgtacggacctaaaccggtcggtaccccgttgggtacggtacgttccggaccggaaaggtaccgaagggtaggaaactccgaacgtacgtggtacgctacggtacactatccgtagtctactnttaccccg

SEQ ID NO: 17753 - DNA, 690 bp, Homo sapiens
  misc_feature: GYAE6OF02JC6HO.3.3.A03.1.454.CMB.1.raw
  modified_base (254)..(254): a, c, t, g, unknown or other
  misc_feature (254)..(254): n is a, c, g, or t
  modified_base (297)..(297): a, c, t, g, unknown or other
  misc_feature (297)..(297): n is a, c, g, or t
  modified_base (412)..(412): a, c, t, g, unknown or other
  misc_feature (412)..(412): n is a, c, g, or t
  modified_base (678)..(678): a, c, t, g, unknown or other
  misc_feature (678)..(678): n is a, c, g, or t
tcagagacgcactccacgaccggtgctcgatttagagagcgtcacagggggaggaactgctcagtcaggacccagagggaaccatggaagcccagctcagcttctcttcctcctgctactctggctcccagataccaccggagaaattgtgttgacacagtctccagccaccctgtctttgtctccgaggggaaagcgccaccctctcctgcacgggccaagtcacgagtgttagcagctacttagcctggtanacaacagaaacctggccagctcccaggctcctcatctagtgangacactacccaacgacgggcctacgtcggcacctacccgagccgtaggtaccgaggtcggacgtacgtgggttcgtagggacacgtacttacgacttcacaccatacgacgtacncccgtagacgccgttaacggaattactttgaccgtaacgttactttaaatttcgtttacgaacctaaacgtcggtaccggttagaacccgttaacggtccgggtaccccttggggtttaaccgggaccgggtttaaccggaacccggtaaaccggggaacccggttaaagggccgggtaaaaccgtaacccgaaaaccggttaccgtaggggttacccggaccgttacgaaccccgttaacgacgtttcccgtacggttttacccncgtttacccccg

SEQ ID NO: 17754 - DNA, 680 bp, Homo sapiens
  misc_feature: GYAE6OF02GRCYF.3.3.A03.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctntcctgcagggccagtcagagtgttagcagctacttagcctggtactacaacagaaacctggaccaggcctacccgaggcctccctacgattcctaatcgattcgctacgtcccaaacgcgggaccaacgtcgggacacctcccacgcccgtaaggttcgaaggtcggacgaggttgggtcctaggggacacggtacctttcgaaccttcgtaccacgtactacgacgtacgcccgtaggaccgtacgtagaacgttagttttacgactaggtccttaagttacgttcgtacaacgtcgtcggtacgaccgtacgttcggacccgttcggtacggaccggtttccgggaaccgtaacgggtaaccgtaagggttacggaaaccgttccggaaaccggtaacggttcggtaccgggtaccgttaccggacctacccggttaaccgttcgtaccgtttacgttccgtacgttacccccg

SEQ ID NO: 17755 - DNA, 687 bp, Homo sapiens
  misc_feature: GYAE6OF02GUB40.3.3.A03.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagngtgttagcagctacttagcctggtatcaacagaactggcaggctccaggctctcatctatgatgctatccgaacgacgggaccactcgggacacgtcccacgccgaaggttccgaggtggacagggttaggggtccgtagggggtacaacggtacctttacgaccttcgtaccaaccgtactacgacgtacgacccgtaagaccgtaccgtagggtaacgttagttttacgacgtagttacgttaatttatttacggtaccaaagtacggtacggttacgggtaccgtaacgtacggtaccccgttcgggtacgggtaacccggttacggggacccggtaaacgggtaacccggtaaacgggtaccggtaaacgtacccgaaaccggtaaaccgtaggttacggaccgtacggtaccaaccggtaccttaccgttacgtaccgtttcgaccgtttaccccg

SEQ ID NO: 17756 - DNA, 789 bp, Homo sapiens
  misc_feature: GYAE6OF02HR3NM.3.3.A03.1.454.CMB.1.raw
  modified_base (198)..(198): a, c, t, g, unknown or other
  misc_feature (198)..(198): n is a, c, g, or t
tcagagacgcactccacgaccggtgctcgatttagagagcgtcacagggggaggaactgctcagttaggacccagagggaaccatcggaagccccagctcagcttctcttcctcctgctactctggctcccagataccaccggagaaattgtgttgacacagtctccagccaccctgtctttgtctccgaggggaaanagccaccctctcctgcacgggccagtcaggtagtgttagcagctacttagcctggtatcaaacgacgtaaacctggacccagggtcctacccgaggccttccctacattctactgactcgctaactacccgaacgacgggccctacgtcggtacctacgtacccgagtccccgtaagggtttccaaggttcgggaccgtaggggttcgggggttaccgtagggggaaacctaacggtaccttttaccgaacgtttcccgtaaccgtaaacccgttagtttacccggtaacggtttaaccgtaacccggttaacggtaaccggtaccgttaacgggtaaacgtttacgtttttacggaccgttaacggtttactttaagttttaacgtttacggttaactaacgtacggttacgtacggtactaaccggttcggtacccgtcggttacgggtaccgttccggtaaccgggtaacggtaaccggtaagggtaacggtaacggtaccgtaaaccggtacggttaacggtacgggtacctacggtacctaaccgttacgtaccgttacggttaccgtttacgaccgtttaccccg

SEQ ID NO: 17757 - DNA, 733 bp, Homo sapiens
  misc_feature: GYAE6OF02I6FIR.3.3.A03.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (290)..(290): a, c, t, g, unknown or other
  misc_feature (290)..(290): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaanagccaccctctcctgcagggccagtcagngtgttagcagctacttacgcctggtatcaacagaacctggccacggcctccccgaggcctccctnactctatgatcgcactccgaacgcgggccacgtggacctacgtccccgagacccgtaggttccaacggtcggaccgtaggggttcggggtcctagggggtaaccctaggtaccgttcctacgttccgtacccaacctagtactaaggtaccgacccgttaaggtaccgtacccggtagtaacggtttacgttttacggaccgttacgttacctttaagtttacgttacgttaaccgtaacgtacgggttccggttacgggttaaccgtccggtaccccgttacggggtacggtttaacccgggttcccgggaccggtaaacgggggtaccctaacggggtaacgtaaccgttaccgaaccggtaacggttggtaccgggtacgtaccggacctaccggtacgttccttacggttaccttccttaccgttcccgttacccccgg

SEQ ID NO: 17758 - DNA, 557 bp, Homo sapiens
  misc_feature: GYAE6OF02F6P0K.3.3.A03.1.454.CMB.1.raw
  modified_base (197)..(197): a, c, t, g, unknown or other
  misc_feature (197)..(197): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (532)..(532): a, c, t, g, unknown or other
  misc_feature (532)..(532): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtatcaacagaaacctggccaggcctccgaggctcctcatctatgatgcactaccaacgacgggccacgtggcactcccagccctaggttcaggtcggctaggtcgggtcgtgggaacnggtaccttcaacttccncacctatcgaagtacgtacctagtcgctagtaagtattttcgactagttcttagtttatntacacngcgtgactacgtcgtcccgtgtcggacgttcggacgaacgggtaccgaagggtacgaataccgaacgtaacgtggtacgtcncgacacacttctgtctactctcccg

SEQ ID NO: 17759 - DNA, 694 bp, Homo sapiens
  misc_feature: GYAE6OF02GD16Q.3.3.A03.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtcctccgaaggggaaanagccaccctctcctgcagggccagtcagngtgttagcagcttacttagcctaggtatacaaacaacgaaacctggaccaggcctacccgaaggcctcctcatctatcgatgcactaccaacgacgggcccacgtcggactactcccagaccgtagttcgaggtggacgtggtgggtccgtagggactagtacttacgactactcaccgtactacgaagtaccgacccgtaagaccgaccgttaagggtaaacgttaagttttcggacttaaacgttctttaaagtttacttacggttaacaaacgtacggtaggtacggacctaaccggtccgggtcccttagggttaccggtaaccggttcgggaacccggtaaacgggacccgtaaaggggtaacgtaaaccgtaccgtaaacccggtaacggttggtaaccggtaccgttacgtacccgtaacgttacttcgttacggtttaccttacgtacccgttacccg

SEQ ID NO: 17760 - DNA, 745 bp, Homo sapiens
  misc_feature: GYAE6OF02HDMK3.3.3.A03.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (430)..(430): a, c, t, g, unknown or other
  misc_feature (430)..(430): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccgganaaattgtgttgacacagtctccagccaccctgtctttgtctccgaagggggaaanacgccaccctctcctgcacgggccagtcagagtgttacgcagcttacttacggccttggtactcaaacagtaaacccgtggaccagggccctaccccgagggtccctcccgtacgtactaccttaagtggtaacttcgacctaacttaaccccgaaacggaccggggtaccctacgtcggacctacctacccgaggtacccaggttccaggtcggactagggtcgggtcgngggaactaggtcttccaccgtcaccgaacctattacgaacgtaccgaccgtaaggtcgtaccgttaagtaacgtttagttttacgaccttaacggttctttaaagtttacgttacggttaaccgaaacgtccgggttcgtaacgggtaccgtaaaccgggttcccgggtaccccggtttacggggtaccgggttaaccgggttaccgggaacccgggttaaacggacccgggtaaagggtaccgtaacgtaccctaacgggtacgtagtcgggtactcggacctacgtacttcgttactcgtttacacccttccg

SEQ ID NO: 17761 - DNA, 760 bp, Homo sapiens
  misc_feature: GYAE6OF02IGUFE.3.3.A03.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (726)..(726): a, c, t, g, unknown or other
  misc_feature (726)..(726): n is a, c, g, or t
tcagagacgcactccacgaccggtgctcgatttagagagcgtcacagggggaggaactgctcagttaggacccagagggaaccatggaagccccagctcagcttctcttcctctgctactctggctcccagataccacggagaaattgtgtgacacagtctccagccacctgtcttgctccgaggggaanacnccaccctctctgcgacggccagtcagtgtgttagctacgtcttacttagccgttaggtactaccgaaacgaacgtaaaccgtggacccgaggtccctaccgacggtaccttcctctacttacgtactagacttcgaacctaaccgtaccgaacggtccggtacctacggtaccggacctaaccgtaccccgaacggtacccggttaggtttaccgacggggtcggtaacggtcgggggtttaccggggttacggtaacggggtaacgtaaccggtttcccttacccgaaccgtttcccgtacccgtaaaccctacggtttaaccgtaacggttaccgtacggtaacggtaccggttacccgtaaggttaacgttttacgttcggaacgtttacgtttactttaagtttacgtacgtaacgaacgtcgggtaccgtacggtaaccgtacccggttcggtacccgtcgggtacgggtccgttacgggaacggtaaacggtacgtaaggtacgacacggtacctaggtcgagtacncaccgtcgtactcggttctacgttcacgttcccg

SEQ ID NO: 17762 - DNA, 766 bp, Homo sapiens
  misc_feature: GYAE6OF02IQIBU.3.3.A03.1.454.CMB.1.raw
  modified_base (233)..(233): a, c, t, g, unknown or other
  misc_feature (233)..(233): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcacgggccagtcagagtgttancgagctacttagccgttggtactacaacagaaaccgtggaccaaggcctacccgaggtcctccgtcacttacctagtgactgacctacgtacccgaaacgacgggccctacgtacggacctacctaccccgacgtaccgtaaggttccgagggttcggacgtagggttcgggtacggacgggtaactacggtaccttccaccgtctaacccacgtactacgtaacgtacgccgttaaggaccgtacgttaggtaaacgtttctttacggtaacgttacgtttactttaagtttactttacggtaacctaaacgttcgggacggttaccggtaacgttaaaccggttccgggtaccccgttcggggttaaccgggtacccggtttacccgggtaaacccgggtaaacgggtaacccgttaaaagggggtaccgtaaccgtaacccggtaacccggtaacgggttcggttaacggtccgtaccggtaccctacgttaccgtcgtttacggtacctttacccgacgtttcccccgg

SEQ ID NO: 17763 - DNA, 781 bp, Homo sapiens
  misc_feature: GYAE6OF02FMOCO.3.3.A03.1.454.CMB.1.raw
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcagggccagtcagngtgttagcagcttacttagcctggtatcaacagaacctggccaggcctccaggtcctccgtntatctagtcgtagtcgctactacccgaaacgtacgggccctaacgtcggacctaacttccccgacggtacccgtagggttaccacggttcggacgttagggttcgggtcgtaggggaactacggtaaccgttcgaccttcctaccgaacctagtccgtaacgtaccgtacgtaacggtacgtaccgttaggtaaacgtttggttttacgaccgttagtttaccgtttaagttttaacgttcggttaaccgtaaacgttacgggtaccggttagggaaacccgttaacgggttcccgggttcccccgttaggggttacccggtaccggggttttaccccggaaccgggtaaaccggggtaacccgttaaggggttaaccgtaaaccgttacccgaaacccgggttaacgttacgggttacgggtaaccttacgggaccccttaccgtacgtttaccgttacgtttacccgtttaaccgtaccgtttacccccgg

SEQ ID NO: 17764 - DNA, 797 bp, Homo sapiens
  misc_feature: GYAE6OF02HX04E.3.3.A03.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagagacgcactccacgaccggtgctcgatttagagagcgtcacagggggaggaactgctcagttaggacccagagggaaccagtggaacgccccagctcagcttctcttcctcctgctactctggctccagataccaccggagaatttgtgttcgacacgagtctccgagccaccctgtcctttggctccgaaggggaaanacgcccaccctntcctgcgacgggccagtacaggtagttcgttagacgagtctaacgtgccgtagtactacaaacgtagaaaccctggaccgacggaccgtccgaacggcctcccgtacgtactactaagtgagtcgaacctacaaccgtaaacggaacgggtcccaacgtacgggtacctaaccgcccgaacgaccggtacgggttaaccagggggtacgtaccggagggggttttacccgggtaggtaccgggtaacgttaacggaaccctttacacgtacccgtaaccgaacctaaccgttaacgaacgtttaccgaccgtttaacggacgtcccgttaagtaacgttacgttttacgaccgttacgtactttaagttaacgttcgttaacgtaacgtaacgtacggtaccggtacgtaaacccggtccggtacccggttacgggttacggtaaccgggtttacggtaacccggtaacgggaaaaccgttaaggggttaaacggtaaaccgtaaccggtaaaccgaacggttaacgtacgggacgttaccgacaacgtcgtaccgttacggttccttaccgtacttacccg

SEQ ID NO: 17765 - DNA, 868 bp, Homo sapiens
  misc_feature: GYAE6OF02JKJ3M.3.3.A03.1.454.CMB.1.raw
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagcgccaccctctcctgcgacgggccagtcgagtacgtgttacgcacgtcttacgttacgcccgttgggtaactacctaaacgacggtaaaaccgttcgggacccaagggtcccttaccccgaacgggtcccttaccccgtacttaccgtaccgttaacgttacggacgttccgaccgtaacgttaacccccggaaaaccggacccggggtacccgttaaccggtggtaacccgtacccgtcccccggtaacggtccccgggtaacggtttaccgaacggggtttaccggaacggtacggggtttcgggggtacgttacggggtaaacccacggtttaactttacccgccgtttaccctaccgtaacccgtacttaaccggtaacgggtaaccggtacccgtaaggtaccggtaccttaacgggtaactttaacggttttcgaccgttaacggtttacttttaagttttaccgtagttacccggaaagtcggtccggtacggttacccgtacggtaccggttaccccggtacggttacgggtaaccggtttccggaaccgaaacgggtccggtaaggtaacggaacttacccggaaacctagggttccggtaaggcccgttaggaaccctaacgtcgtttacggttcgttaccttaccggtacccgttacccg

SEQ ID NO: 17766 - DNA, 942 bp, Homo sapiens
  misc_feature: GYAE6OF02JHS0P.3.3.A03.1.454.CMB.1.raw
tcagagacgcactccacgaccggtgctcgatttagagagcgtcacagggggaggaactgctcagttaggacccagagggaaccatggaagcccagctcagcttctcttcctcctgctactctggctccagactaccgaccggaagaaattgtgttgacacagttcctccacgccctacccttgttccttttcgtaccgtccgaagggggaaagcgacccacccttccttcctggaccgacgggtaccctaggttaccaagggtacgtttacgttacggacctaacggtacctttaaccgtttacggacccgtttgggaacttaaccgaaaaccgtaaaccggtaaaccggtccgggtacccgaacgggtaccctaccccgtaacgggtccccttaccccttacgtaacttacccgttaagttaccggtaacgtccgtaaacccgtaccgttaaaaccccggtaaagggaaccggggtacccctaaacggttcccgggaccttaaccccgtaccccggtaaccgtaacccgttacgggttacggacggttacggaccggttaggtccggggtaccggtacgggtaaactacggtacccgtttaccgaaccgtttcccgtacctaaaccgtacgtttacccgtaggttaaccggtacccgtaacgggacgttaccgtaacggggttaaactttagttttaacccggacgtttaacgtttaacgtttaacgtttaaccggttacgttacgtaaacggtcgggtttacggttaccggaacttaccggtacccggttacgttaccgggtacgttacccggggttaacgggtaaccggaaacggttaaccggtaagtaacggtaaccgttaaccgtaaaccggtcggttaacggtcgaacctggtacctaacggttctaacggttccgttactccgttaccgtacccg

SEQ ID NO: 17767 - DNA, 807 bp, Homo sapiens
  misc_feature: GYAE6OF02IGZVY.3.3.A03.1.454.CMB.1.raw
tcagagacgcactccacgaccggtgctcgatttagagagcgtcacagggggaggaactgctcagtttaggacccagagggaaccatggaagccccagctcagctctcttcctcctgctactctggctcccagataccaccggagaaattgtgttgacacagtctccagccaccctgtctttgtctccaggggaaagagccaccctctcctgcacgggccagtcagagtgttagcagctacttacgcctggtatcaacagaacctggccagcctccagcctcctcatctatgatgcactacccaacgcgggccacgtcggacctacgtcccacgtccgtacggttccaggtcggacgtagggttcgggttcgtagggaaccacgtaccgttccacttccgtacctacccaagtccgtaacgttacgtacccgtaacgacgcgttaacggtaagttagttttcgacgttacgttactttaacgttttagtttacggtaacctaaacggtacggttaccggtacgggtacccgtaacggttaccggtccccgttaccgggtttacggggtaacccgggtttacccggggtaaccccgggtaaaacgggggtaaacccgtaaaacgggggttaaccggtaaacgttaacccgggtaaaccccgggtaaaccggtttaccggggttaaccggggttaacccggttaacccgggtaaccccgttaaaccccggtttaacccgtttaccccgggttttaccggtttttacccccggttttaacccgttacccccggtttttaaccccccccggg

SEQ ID NO: 17768 - DNA, 713 bp, Homo sapiens
  misc_feature: GYAE6OF02IAQP3.3.3.A03.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (701)..(701): a, c, t, g, unknown or other
  misc_feature (701)..(701): n is a, c, g, or t
tcagagacgcactccacgaccggtgctcgatttagagagcgtcacagggggaggaactgctcagttaggacccagagggaaccatggaagccccagctcagcttctcttcctcctgctactcgtggctcccagataccaccggagaaattgtgttgacacagtctccagccaccctgtcttgtctccgaggggaancgccaccctctcctgcgacgggccagtcagagtgttagcagtcttacgttagcctggtactcgaaacgagtaaacccgtggacccacggtccctcccgaggtcctcccncgtaattccgtaatgacgtnactacgtaccaaacggcgggccacgtcggacctaccgtcccgagccgtacggttcgaggtacggcgtagggtcgggtccgtagggtaacagtccgttaccacttccacgactagtactacgtacgccgtaagcgtacgtagtaagttacttcgacttacgttacttattacgttcgtaacgacggtacggtaccggaacggtaccgttaacccggttacccggtaccgttacgggttaccgggttaccggttaccgggaacccggtaaacgggtaacccgttaaggggtaaccgtaaccgtaacccggtaaccggttaacggtcgtaccgggtacctcggaacccttcggttacttcggttaccttacccgttacncccgtttacccg

SEQ ID NO: 17769 - DNA, 1117 bp, Homo sapiens
  misc_feature: GYAE6OF02FLM7N.3.3.A03.1.454.CMB.1.raw
tcagagacgcactccacgaccggtgctcgatttagagagcgtcacagggggaggaactgctcagttaggacccagagggaaccatggaagccccagctcagtctctcttcctctgctactctggcctccagactaccgaccggagtaaattgtgttagacacgtacgtcctaccgacgccctaccgttgttcgttttcgtcctaccggaagggggtaaaacgtcggacccgtaaccccgttcttcccgtacgaccgacggggacctacgtaccgtaaggtaggttagtttacggcgtaacgtacctttacgttacgtccgttaggttaactacctaaacgtaaacgtaaaccgtacggtacccgtaccggtacccgttacccggacggttacccttacccgtaccggtaattaccctttaagtaccggttaacgtacggttaacctaacccggtttaacccggtaaacccggaaccggggtaaccccgttaacggtacccgggttaaccgtaacccctacccgggtaacccggttaacccggtttaccgggtttaaccggtaacgggttacgggtaccgggtttaaacgggggtccggggtttaacccggttaacgggggtaacccgttaaaccggtttaacccggttacccgttaaacccgttcccgttaaccccggtaaacccttaccggttaaccgttaacgggtttaacccgtaaacccggtttaaaccggtacccgttaaccggtttaaacgggtttaacgttttaaccgtttttacgggaccgttttaaacggtttaccgtttttaaagtttttaaccgggtaaccttaaccgtaaaacccgggtttccggggtaaccggtttacggtaaccccgttaaacggggtttccccggtaaacccggtttcccggggttaacgggttacccgggtttaccgggaaaaccgggttaacccgggtaaacccgggttaaaaggggtaaaccgtttaacccgggtaacccggtaaaccgggttacggtttaacggtaccgggttaaccgttaaccgtacccgtaacccggtttgtttacccgtttaaccgtttcgtttaaccgtccctttaaccccggg

SEQ ID NO: 17770 - DNA, 799 bp, Homo sapiens
  misc_feature: GYAE6OF02G8VHN.3.3.A03.1.454.CMB.1.raw
  modified_base (144)..(144): a, c, t, g, unknown or other
  misc_feature (144)..(144): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccgganaaattgtgttgacacagtctccagcccaccctgttctttgtctaccgaaggggaaagcgcccaccctctcctgccgacgggccaggtccgaagtacggttgttacgacagtcctttaacgttacgccgttagggtactaccgaaaacgtaacggtaaacccgtgggacccgtagggtcccttacccccgaaggtccccttccctataaccgtttcctaacgtcggtaattccgacctaacctaccccgaacggtaccggggccccaacggttccggaacctacccggtccccaagggtaccccgttaagggttacctaggttaccggccgtaaggggtttcggggaccggttacggggaacttacggttaccctttacgtacccttaccgtactaacccgtactacgtaacgtaccgtacgtaacggacgtaccgtagtaagttgtttacgacgttacgttacgttatttacgttagtaccgtaacgtacgtacggtacggtccgtaacggtccggtacccgttacggcggtaccggttaccgggaccggtaacggtaaccgtaaggtaccgtaacgtaccgaaccggtacggtacggtacggtaccgtacgaccgtacctacggttcttaccgtttacgttactaccgttcccg

SEQ ID NO: 17771 - DNA, 619 bp, Homo sapiens
  misc_feature: GYAE6OF02HSNS4.3.3.A03.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
tcagagacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggcagtcagtagtgttagcagctacttagcctggtatcaaacagaaacctggccaggctccccgaggcctcctcatctatgatgctatccaacgngggcccacgtggccatccccagaccctaggttccaggtcggctagggtgggttcgtgggtaccngtaccttcacctcgcaccatcagtacgccgtagaggcctagtacgtatttagctacgttcttaagtttntttcgtactaaccgtacggtacgtcggtacgtaacgtcggtcccgtcggtcgggtaccggttaccggtaccggtaaacgggaaccgtaacgggtacggtaacgtaccgaaccggtaacgtacggtaggtaccgtacgtaccgacctacgtaccttcggttaccgttactacttacccg

SEQ ID NO: 17772 - DNA, 697 bp, Homo sapiens
  misc_feature: GYAE6OF02GJYIP.3.3.A03.1.454.CMB.1.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
tcagagacgcactccacgaccggtgctcgatttagagagcgtcacagggggaggaactgctcagttaggacccagacgggaaccatggaagccccagctcagcttctcttcctcctgctactctggctcccagactccacggagaattagtgtttgacacagtctccagccaccctgtcctttgtactccgtagggaaaggcgaccacctctcctgctagggccaggtccagtcgtggttancagctacgttacacttggtactcgaacagaactcggccaggcctaccgtacgcgtcctcgacttctatgtatcgactactccgaacgtacgggacctaggtcggaccnccgtacccgagtacgtacggttccgaggggtcggtcgtaggtcgggtctacgggtactcgttaactcgtacctcaccaccgtacgcgtagtacctcgtagacgtacgtagtaacgttcgtttacgacgttacgtttacttacgtttacgttccgtaacgaccgttacgttacggttacgtaccgttaacgttaccgggttcccgttacgggttaccgggtaccggtttaccggaaccggtaaacgggtaaccgtaagggtacgtaacgtaccgtaaacggtcgttacgggtacggtacgtaccgtccgaactcgttaccgttacgttccgttacctacgtttccccg

SEQ ID NO: 17773 - DNA, 486 bp, Homo sapiens
  misc_feature: GYAE6OF01APVN9.41.81.H04.1.454.CMB.1.raw
tcagtctatactatcacgaccggtgctcgatttagtagtgtagattcgcgggagtcagacccactcaggacacagcatggacatgagggtccccgctcagctcctgggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtgggtcccatcaaggttcagcggcagtggatctggcacagatttcactctcaccatcagcagcctgcagcctgaagtattttgctaacttattactgtactacaagtattacaattaccctcgtacttttggcctaggggaccaggctggagatacaaacgactgtgctgcaccgtac

SEQ ID NO: 17774 - DNA, 493 bp, Homo sapiens
  misc_feature: GYAE6OF01D9U7N.41.81.H04.1.454.CMB.1.raw
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccacttacaaagtgggtcccatcaaggttcagcgcagtggatctggcacagtatttcactctcaccatcagcagcctgcagcctgaagtattttgctaactttattactgtactacaagtattaactaattaccctcggtacttttggcctagggaccaggctaggagtanacaaacgaactgtagntgcacgtac

SEQ ID NO: 17775 - DNA, 510 bp, Homo sapiens
  misc_feature: GYAE6OF01D3PT1.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtgggtcccatcaaggttcagcggcagtggatctggcacgagtactttcactctcaccatcagcagcctgccagcctgaagtattttcgctaacttattactgtactacaagtattaactaacttacccgtacgtacgttttcggaccctaggggaccaggtctggacgatacgaaacgaacgtggtacgctcgctactac

SEQ ID NO: 17776 - DNA, 549 bp, Homo sapiens
  misc_feature: GYAE6OF01E0T3A.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccgggcaagtcagggcattagaaatgatttagcctggtatcggcagaaaccaggaaaagcccctcagctcctcatctgtactgcatccactttacaaagtggggtacccatcaaggttcagcggcagtggatctggcacagtatttcacttctcaccatcagcaagcctgcagcctagaagtattttagctaactttattactgttactaactaagtacttaactaacttacccgtacggtacttttcggaccgtaacggggtaccagggtccgttagggaagcgttaaccgaaaacggtaaacgtaggttacgggaccttcggaccaacccgttaacg

SEQ ID NO: 17777 - DNA, 524 bp, Homo sapiens
  misc_feature: GYAE6OF01A5LV8.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtgggtcccatcaaggttcagcggcagtggatctgcacagatttcactctcaccatcagcagcctgcagcctgaatatttgactaacttattactgttactaactaagtatttaacctaactttaccccgtacggttaccttttacggaccgtaggggacccagggtcgtagggacgaactacgaaaacgtaactggtaggctacgccaccgtac

SEQ ID NO: 17778 - DNA, 550 bp, Homo sapiens
  misc_feature: GYAE6OF01D3D4E.41.81.H04.1.454.CMB.1.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccggnaagtcaggcattagaatgattagctgtatcggcaagaaacaggaaacncccctcacgctcctcatcgtgtactgctatacctactttaacgaaaggtcgggtacccatcgaaggttcagcggcaggtggactcgtggcacagtactttcactctacaccatcacgcagcctgcagcctagtaagtattttacgacttaacttattactgtactaactaagtacttaacctaacttacccgtcgttacgtttcggaccgtacggggaccgtacggtcgttagggacgtaactaacgaaaacggtaacgtggtacggtacgtacggcctaccgtacg

SEQ ID NO: 17779 - DNA, 545 bp, Homo sapiens
  misc_feature: GYAE6OF01D2689.41.81.H04.1.454.CMB.1.raw
  modified_base (271)..(271): a, c, t, g, unknown or other
  misc_feature (271)..(271): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaaggaaacncccctcagctcctcatctgtactgcatccactttacaaagtgggtccatcaagttcagcggcagtggatctggcacagtatttcacttctacacatcagtcagcctgcacgtcctagaagtattttcgactaacttattactgttactaacgtaagtactttaacaactttacccgtcggttaacctttcgggaccgtaacgggggtacctacgggtcgttagggacgtaactaccgaaaacgtaacttgggtacgtgtacggccaaccgtacg

SEQ ID NO: 17780 - DNA, 769 bp, Homo sapiens
  misc_feature: GYAE6OF01EKQ1I.41.81.H04.1.454.CMB.1.raw
  modified_base (270)..(270): a, c, t, g, unknown or other
  misc_feature (270)..(270): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaacncccctcagcctcctcatctgtactgctatacctaacttttaacgaaacggttcggggtacccctaagtaccgtaaagggtttccgaaggtccgggacgtaggttcgggtacttcgtacgggacctaacgtaaggttacttttaccgaaccttaccttacccaaccctaagttaccctaacggcccgtaacgtccccgttaggacccgaagggttacccccgttaagggttaaaacgtttacttttttaccggaacctttaaaccgtttttaaacgtttaccgttaacggtttaccttaaaaccgtaaacggttaaccttttaaacccgttaaaccgtttttacccccggttacggggtttaaccgtttttaccggggacccggtaaaccggggggtacccctaagggggtaccccgtttaggggaaacggttaacgtaaacccgtaaaaccggtaacgttacgggtacgggtacccgttacggaccctacccgttaacg

SEQ ID NO: 17781 - DNA, 534 bp, Homo sapiens
  misc_feature: GYAE6OF01BARUP.41.81.H04.1.454.CMB.1.raw
  modified_base (283)..(283): a, c, t, g, unknown or other
  misc_feature (283)..(283): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcacattactgccgggcaagtcagggcattagaatgatttagcctggtatcggacagaaaccaggaaaacgcccctcagctcctnatctgtactgcatccactttacaaagtcgggtccatcaaggttcaggcgcaggtggatcgtggcacagtatttcactctacaccatcagtcagacctgccacgcctgaacgttatttcgactaactttatactgtactacaagtacttaactaacttacccgtcgttacgtttcggaccgtaacggggacctacgggcgttagggaacgtactaaccgtaaacgactggtacggcttacggcctaccgtac

SEQ ID NO: 17782 - DNA, 634 bp, Homo sapiens
  misc_feature: GYAE6OF01B1DBZ.41.81.H04.1.454.CMB.1.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (330)..(330): a, c, t, g, unknown or other
  misc_feature (330)..(330): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccgggcaagtcagggcatagaatgtatttagctgtatcgcagaaacaggaaacncccctnacgcctctcatctgtactgcatcctacttaacgaagtcgggtaccatcgtaagtcagcgnagtggtatcgtggcaacgtagtaactttccgaacttccgtaccaaccctacgttaccgaacgacccgaacgtcccgtaggacccaacggtcccttaagggtaaacgtttacttttacggacctttaaacttttaacgttacttcgttaacctaacgtaaagtaactttaacctaacgtttaccccggttacggtttaccggttttacgggacccggttaacggggaaccctagggtaccggtagggtaactaaccgttaaccgtaaacgtacgttcggtacggtactaccggtcctaccttacg

SEQ ID NO: 17783 - DNA, 719 bp, Homo sapiens
  misc_feature: GYAE6OF01DD9CN.41.81.H04.1.454.CMB.1.raw
  modified_base (492)..(492): a, c, t, g, unknown or other
  misc_feature (492)..(492): n is a, c, g, or t
  modified_base (682)..(682): a, c, t, g, unknown or other
  misc_feature (682)..(682): n is a, c, g, or t
  modified_base (696)..(696): a, c, t, g, unknown or other
  misc_feature (696)..(696): n is a, c, g, or t
tcagtctatactatcacgaccggtgctcgatttagtagtgtagattcgcggggagtcagacccactcaggacacagcatggacatgagggtcccccgctcagctcctggggctcctgctgctctggctcccaggcgccagatgtgccatccagatcgacccagtcctccatcctcactgtctagctatctagtaggagaacagacgtctaacctatttaccgttcggaccggaccgaaggtcgaagggtactaagttaaagtaaattcgtaagtttacggccttaggtacgtcggacgaaacgtaaaccgaaaggaaaaccgcccccttacgaacgtccttaccgtactacgttcgtacgttacctgaccttacttaccttaaccgttaacgaacgggttcggtaccagttacgtaacggttcaacggcgacgtaggtgtacgtacgcggacacgtagttacttacctacctactaccacctataccgaacncctaacgcgtacgacgtaccgtacgtaacggtaactttgtttaccgtaacttaacttttacgtacgttacttacctaaacgtaaagttaccgttaactacccgtttaacccggttacgtttaaccgttccgggtaaccgggaacccggtgaaccggttcgaagggtaactccgtaaaaacggtaacccgngttaccgggtaacnccgttcgaaccccgtagttaccg

SEQ ID NO: 17784 - DNA, 747 bp, Homo sapiens
  misc_feature: GYAE6OF01EJEAE.41.81.H04.1.454.CMB.1.raw
  modified_base (176)..(176): a, c, t, g, unknown or other
  misc_feature (176)..(176): n is a, c, g, or t
  modified_base (328)..(328): a, c, t, g, unknown or other
  misc_feature (328)..(328): n is a, c, g, or t
tcagtctatactatcacgaccggtgctcgatttagtagtgtagattcgcggggagtcagacccactcaggacacagcatggacatgagggtccccgctcagctccgtggggctcctgctgctctggctcccaggccgccagatgtgccatccaggatcgacccagtctccatcctnactgtcctgcattcgtggtaggagacagacgtcactaatttacgtcggaccgggataaggtcgaaggctaagtttaagaaaagttggtaacttttaacggccttagggttaacgtcgggaaccaaacggaaaaccgtaacgggaaaaccccnccccgtacgaccgtccttacctagtacttcgttacgtaccgtcgaaccttactaaccgttaacgtttaaacggaacgggtccggtaaccctagtaccgtaacggtacaggtacgacgtacggtacgtactacggtagacctaagttacgtttaccttacccgacttacccaccgtaactacgtaccgacgtacccgtacgtaccggtacgaaccgtacgtaccgttaagttaacgtttacgtttaaccgtacttttaacttacgttaacgttacgttaactaaaccgttaacgttaaactttaacccgttaacgtttacccggttacggtttacggttacgggaccggtaacgggtacgtacgggtactaagaacgtaaacgtaacgaaacgttagtcggacgtataccgtccagttcg

SEQ ID NO: 17785 - DNA, 635 bp, Homo sapiens
  misc_feature: GYAE6OF01AI7WX.41.81.H04.1.454.CMB.1.raw
  modified_base (303)..(303): a, c, t, g, unknown or other
  misc_feature (303)..(303): n is a, c, g, or t
tcagtctatactatcacgaccggtgctcgatttagtagtgtagattcgcgggggtaggtcagacccactcaggacacagcatggacatcgagggtccccgctcagctcctggggctcctgctgctctggctcccaggcgccagatgtgccatccagatcgaccccagtcctccatcctcactgtcctggacatcctgtaggacgacagagtccacctattacttggccgggcaagtcagggctattacgaatgatttacgcctaggtatccggacaagaaacccagggaaaaccgccccctanacgtctcctcacttcctgtacctgccactccctactttacaaggttcgggacccagtacgtaaggttcgagcggcgtaggtcggactcgtaggactacgtagtactttcacttcctacacatcgacgcgacgtccgtcgacgtaccgtctagtacgttactttacgtacttaactttattaccgtacgttaactaacgtaacgttaaccttaacctaacgtttaccccgtacggttacccgtttcggacccggtacgggtacgtaacgggtcggtaggaacggtacgtaacggtaaacgtacgtcgggtacgtaccgtcgtaccgtcgtacg

SEQ ID NO: 17786 - DNA, 725 bp, Homo sapiens
  misc_feature: GYAE6OF01CH02D.41.81.H04.1.454.CMB.1.raw
  modified_base (284)..(284): a, c, t, g, unknown or other
  misc_feature (284)..(284): n is a, c, g, or t
  modified_base (409)..(409): a, c, t, g, unknown or other
  misc_feature (409)..(409): n is a, c, g, or t
tcagtctatactatcacgaccggtgctcgatttagtagtgtagattcgcgggggagtcagacccactcaggacacagcatggacatggagggtccccgctcagctccgtgggggctcctgctgctctgggcctcccgaggcgccagatgtgccatccagatcgacccagtcctccatcctcactgtctgcatcgtggtaggacgacagagtccaactagtttacgtcggaccgggacaaggtcgagggctaattaagaaatgtattacgcgtggtacgtcgganaacgaaacgagaaaccgccctacacgtcctcctatacttctacgtactgactacttacctaacgttaacgtaacggtcggtacctagtacgtacggtacacggcgagtagtcggtactgtacganacgtagttacttctacctcgtaccactactacgaacgtcaccgtccgataccggtcgaaccgttagtaacgtttactttaacccggtaatttaacgttttacgttacgttaaccgttaacttaaccggtaaaactttaccttaaacctttaaacccggtttaccccggttaagggttttacccgtttaaggggaccccggttaaaccggggtaccggttagtacccgggttaaagggaaccgttaaccggttaaacccgtaaaacgggttacgttcggggtacgttacccgtaacggtacccctaaccggtttacc

SEQ ID NO: 17787 - DNA, 704 bp, Homo sapiens
  misc_feature: GYAE6OF01BLFYD.41.81.H04.1.454.CMB.1.raw
  modified_base (272)..(272): a, c, t, g, unknown or other
  misc_feature (272)..(272): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcacattactgccgggcaagtcaggcattagaaatgatttagcctggtatcggacaagaaaccgaaggaaaccncccctacgacgtcctcctcatcgtagtactgacctacttacctaactttaacgaaacggttccgggtaccctagtacgtaaggttccgaaggcggtacgtaaggtcggtacttcgtacgggtacctaacgtaagtacttttaccgacttccgtacctaacctacttacgaacgtacctaacgtccgtacgaccgtacggtccgttaaggtaagtttacgtttacgaacttttaaacgtttaacgtttaccgtacgttaaccttaaacgttaaacggttaacctttaaaccgtaaaccgtttaccccggttacggtttaaccgttttaccgggaccgggtaacggggtacccgtacgggtacgttagggaaacgtacgttaaaccgaaaccggttacgtagggttacgtacgtacgtaccgtaaccgttacgg

SEQ ID NO: 17788 - DNA, 814 bp, Homo sapiens
  misc_feature: GYAE6OF01BTPVW.41.81.H04.1.454.CMB.1.raw
  modified_base (193)..(193): a, c, t, g, unknown or other
  misc_feature (193)..(193): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctggtagganacagagtcacctattacgtggccgggacaaggtcgagggctaattaagaaattgaatttagccgttaggtactcggactaaacggaaaaccgaacgggaaaacgcccccgtacgacgtcctccctacacgttctacggtaactcgacctacttacccttaacgtttaacgaaacgggttccggggtacccctaagttaccgtaaacgggtttaccacggggaccggtacgtaacgggttggtaacttccgggtaggaaccctaacgtaacggttaacttttaccctaaccttcccttaacccgtaaccctaacgttcccgaaacggtacccaaccggtcccgtacgaccgaaccggtaccgttaacggtaaacgttttacgtttacgttaacctttaacgttttaactttaaccgttacgttaaccgttaaacgtaaacgttaaccgtttaaaccgtttaaaccccgtttaacccggtttaaccggtttaccggttttaaccggggaacccggtaaccgggggtaacccgtacgggtaaccggttagggaaacgtaaccgtaaaccggtaaaaccggtacggttacgggtaccggtacgttacgacccgtaaccttaccgg

SEQ ID NO: 17789 - DNA, 754 bp, Homo sapiens
  misc_feature: GYAE6OF01D7KUA.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatcgacccagtctccatccctcactgtctgcatcgtggtaggagacagacgtaccacctattacgtcggaccgggactaaggtcgagggactaagttaagaaagtgtagtttacgaccgttaggtactaccggacaaacggaaaacccgaaaggaaaacccgccccctacgaaccgtcccttacccgtataccgttcttaccggttacctacgtccttaaccttacccgttaaaccgttttaaacgggtaaaacgggtttcccggggttaacccctaacgttaccggtaacgggtttccgaacggtccggacgtacggtcggtactcgtacgggacaacgtagttactttacctacctactacctaccactcgacgcaacgtcctagaccgacgtaccttaagtaaacgtttcttttacgaaccgttttaactttatttaccgtacgttaaccttaacgtaaagttaacctttaaacccgtaccgtttaccccggttacggttccgttaaccggccgggtaaacgggtaccgtagggtacgtagggaacgtataaacccgtaaaccgttaggttcgtacggtactaccgtacgttccttacg

SEQ ID NO: 17790 - DNA, 705 bp, Homo sapiens
  misc_feature: GYAE6OF01B91I5.41.81.H04.1.454.CMB.1.raw
  modified_base (321)..(321): a, c, t, g, unknown or other
  misc_feature (321)..(321): n is a, c, g, or t
tcagtctatactatcacgaccggtgctcgatttagtagtgtagattcgcggggagtcagacccactcaggacacagcatggacatgagggtccccgctcagctcctggggctcctgctgctctggcctcccaggcgccagatgtgccatccagatgacccagtctccatccctcactgtctgcatctggtaggagacagacgtaccaacctatttaccgttcggaccgggactaaacggtcgaaggggactaagttaagaaaatgtaatttacgccttaggtatcgggacaaacgaaaaccgaaggaaaaccgtcccctanacgccttacctcgtactctacgtactgactactacctaactttaacgaaggtcgggtaccatacgtaaggttcacggcgactaggtggactcgtaggacaagtacgttactttaccacttcgacctaacctataccgagtactacgtacctagaccgtacgtaccgttaagtaaacgttacgttttaccgaactttaaaccgttttaattacgttattaacccgtaaataaacggttaacttaacgttaaacctttaccccgttaggttaaccggttttccgggaaccggtaaccggggtaaccgtacggtacggttaaggaacgtaacgtaaaccggtaaaacttacggttagtaaccggtagttaccgaacctaacgttacg

SEQ ID NO: 17791 - DNA, 665 bp, Homo sapiens
  misc_feature: GYAE6OF01AGXXD.41.81.H04.1.454.CMB.1.raw
  modified_base (268)..(268): a, c, t, g, unknown or other
  misc_feature (268)..(268): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccggcaagtcaggcattagaatgattagcctgtactcggacaagaaaccaggaaaccncccctagacgtcctcctactacgttctacggtactgcctaacgtaccctaacttttaaaccgaagggttaccgggtaccctagtaccgtaaacggttccaggtacgggacctaagggtacggtacttccggtacggaccctaacgtacgtaaccttttaccaacccgtttccgaccaaccctagtaccgtacgaccaacggtcctacgaccgtacgtaccgttaaggtaacgtttactttacgaacctttaacgtttacttaacgtaccgttaacgtaaactaacgttaaactttaacctaactttaccccggttagttaccgttacgggccgtacggggaacctgggtcgtagggactacaaccgaactagtcggttcgacgtacacctaccgtac

SEQ ID NO: 17792 - DNA, 842 bp, Homo sapiens
  misc_feature: GYAE6OF01BUVNK.41.81.H04.1.454.CMB.1.raw
tcagtctatactatcacgaccggtgctcgatttagtagtgtagattcgcggggagtcagacccactcaggacacagcatggacatgagggtcccgctcagctcctggggctcctgctgctctggctcccaggcgccagatgtgccatccagatcgacccagtcctccatcctcgactcgtctgcatcgtggtaggagacagacgtcacctactttacgttcggccgggacaaggtcgagggacattagaatgtattacgccgtggtacgtcgacaacgaaacgaacggaaaccgcccctagacgtcctacctactacttcgtacgtactcgactaactaccctaacgtttacgaaagggttccgggtaccctaagttacgtaacggttcgacgggacgcgtaaggtcggtactcggtagacgtaactagttacctttccaccttaccgacctacccgtacgtaaccgtacgtacccgtaacggtcccgtacggtacccgtaacgggttacccgttaaagggttaaacccgttttaacgtttttaaccggtaacccgttttaaaacccttttttaacggttttaaccgggttaccttttaaaccggtaaaccgtttaaacggtttaaaacccgtttaaaccctttaaacccccggtttttaaacccgggtttacccggggttttaaacccggttttaccccggggaacccgggttaaaccgggggtaacccggtaccggggttaaaccttacgggggtaaaccggttaaccgtaaaacccggtaaaacggttaaccgggtccgggttaacgtcccgggtacctacccgggttaacccttaacg

SEQ ID NO: 17793 - DNA, 708 bp, Homo sapiens
  misc_feature: GYAE6OF01BIQYD.41.81.H04.1.454.CMB.1.raw
  modified_base (171)..(171): a, c, t, g, unknown or other
  misc_feature (171)..(171): n is a, c, g, or t
  modified_base (311)..(311): a, c, t, g, unknown or other
  misc_feature (311)..(311): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctcatcctnactgtctgctattcgtaggtaggagacagacgtccaacctagtttaccgttcggacccggggactaaggtccgaggggtctaagttaagaaattgtatttacgcctggtacgtcggacaacgaaaaccgagggaaaaccnccccctagaacgtcctacctcacttcgtacgtaccgtggacctagtaccctaacgtttaacgaacggttccgggtacccagttacgtaacggttcacgggtcgacgtaggtcggtacttacgtcgggacaacggtaacgttatttacccaccgttacgtaccctaacctaacgtccgaacgaccgtacgtcccgtaacgaccgacccgtaaccgtagtaacgtttactttacgaactttaacttacgttacgttactaaccgtaacgacgtttaaacttaaccgtaccgtttaacccggtacggttaaccggtttcggaccggtaccgggtaccgtaggtacgtacgggaataacggtaaaccgaacggtacgttagcggttcaccgctacgttacg

SEQ ID NO: 17794 - DNA, 699 bp, Homo sapiens
  misc_feature: GYAE6OF01AF7X7.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatcgaccccagtctccatcctcactgtctgcatctgtaggagacagagtcacctatttacgttcggccgggactaagtcgagggcattagaatgatttacgccgtgtatcggacaacgaaaccaaggaaacgcccctagacgtcctccgtcacttctcgtactcgactactacctacttaacgaacggttcgggaccctagtacgtaggttcacggcggactaggtgtactcgtacggacctacgaagtttacttactacctcctaccgtaactactaccgacgtacccgtacggtcccgttagtacccggaacggtaccgtaacggtaaacgtttacttttacgaaccgtttaactttaacgtttactttcgttaacctaacgtaaacgttaacttaacccgttacccgtttaacccggttacgtttaccggtttaacccgggcggtaaccgggtaacccgtaggtccggtaaggtaaacgtacgtaaaccccgttaaaggtcccggttaacggtacggtcgtttaaccggccctaactttaccgg

SEQ ID NO: 17795 - DNA, 762 bp, Homo sapiens
  misc_feature: GYAE6OF01CEK2D.41.81.H04.1.454.CMB.1.raw
  modified_base (98)..(98): a, c, t, g, unknown or other
  misc_feature (98)..(98): n is a, c, g, or t
  modified_base (156)..(156): a, c, t, g, unknown or other
  misc_feature (156)..(156): n is a, c, g, or t
  modified_base (385)..(385): a, c, t, g, unknown or other
  misc_feature (385)..(385): n is a, c, g, or t
  modified_base (739)..(739): a, c, t, g, unknown or other
  misc_feature (739)..(739): n is a, c, g, or t
tcagtctatactatcacgaccggtgctcgatttagtagtgtagattcgcggggagtcagacccactcaggacacagcatggacatggacgggtccccnctcagctccgtggggcctcctgctgctctggcctcccgaggcgccagatgtcgcctanccgagactcgacccagtcctccactcctctactgctgctacgtcgtaggtaggagacagacgtacacctacgttacgtcggaccggacgtagtacggaggtactaagttaagtaagtcgttacgtttacgccgttaggtacgtacccggtaaacgaaacggaaaacccggaacggtaaaacccctccccgtacgaaccgtccccttactactacgttacctagttaccncgtaccttaccttacccgttactttaaaggaccggtccggtacctaagtaaccggttaggacacgggtcgagttacggagtaccgacggtacgactaacgttgttacctacgtcctacgttacaccgtactacgacgtccgtaacgcgtaacggactacgtacgtaagttccgtttacgtttacaaccgtttatttacgtaccgtttactaaccgttaaccgaaacgttacctttaaaccgtaccgtttaccccgttacggttacgggttaccggaacccgggtaccgggtagtaccgggtaacgtaacgtaacgtaaccggaaacgtaaccgggttaaccgtcgggtaacccncggtacctaaccgtagtttcccg

SEQ ID NO: 17796 - DNA, 768 bp, Homo sapiens
  misc_feature: GYAE6OF01BOYUR.41.81.H04.1.454.CMB.1.raw
  modified_base (281)..(281): a, c, t, g, unknown or other
  misc_feature (281)..(281): n is a, c, g, or t
  modified_base (489)..(489): a, c, t, g, unknown or other
  misc_feature (489)..(489): n is a, c, g, or t
tcagtctatactatcacgaccggtgctcgatttagtagtgtagattcgcggggagtcagacccactcaggacacagcatggacatgagggtccccgctcagctccgtggggctcctgctgctctggctccaggcgccagatgtgccatccagatcgaccagtctccatcctcactgtctgcagtcgtagtaggacgacagagtaccactaattacgtcggaccggagtaagtcgagggactaagttaagaaatgtaatttaggccttaggtacgtacgganaaacgaaaaccgaaggaaaacctcccccgtagaacgtcctaccctacgtacttacgtacggtactcggaactacttaacccgttaaacgttaacgtaaagggttcccgggtaacctaagtacgtaacggtacgtacggacggaatcgggtagaacgtcggtaggaacctaagtacgttacctttaccgaactttacacccgtaaaccncgttaacacggtacctaccggtaccgtacgacggtaaccgtcgtaaaggtaaacgttttactttaccggaactttaaacgtttacgttaaccttaccgttaagtaaaaccctaagtttaaaccttaaccgtaaacgttttacccgttagggttacctttaacggggaacccggtaaccggggaaattaccgggtaaaggtaccgaaacgggtaaaactaaaccgggtaaaaccggttactagggtaccgtaaaccgtacgtaacccgtaacggttaccg

SEQ ID NO: 17797 - DNA, 842 bp, Homo sapiens
  misc_feature: GYAE6OF01BQ9FG.41.81.H04.1.454.CMB.1.raw
tcagtctatactatcacgaccggtgctcgatttagtagtgtagattcgcggggagtcagacccactcaggacacagcatggacatgagggtccccgctcagctccgtgggctcctgctgctctggcctccgaggcgccagatgtcgccatccgagatacgaccctagtcctccatcccgtactacgttcgtcgtgcctatcgtaggtacggatacgagtacgtaccactacttacgtcggaccggactaagtcgaggtactaagttaagaagtgtaacgttacgtacgtaggtacgtacggtacgaaacggtaaaccgaacggtaaacccctccccgtacgacggtacccttaccgtaccgtacgttaccgttacgtaacgtccggacctaaccgttaccgttaaacgttaaccggtaacgggttaccgggtaccctaagtaccgtaacggttaccacgggtacgtaccgtaggtaccgagttccgggtacgtaccgtaacgtacgttaccttaccgtaaccgtcgtaaccctaaccgacgtaacccgtaggtaaccccgtacggtacccgtacggtaacccgtaacgttaaccggttaaagtaaccggttttacgttaacccgtaaccgttttaaccgtttaaccggtttacttaaccggttaacgtaaacccgttaaacgttacccgtttaaacccgttaacggtttaccccgttaccgggtttaaccgttaccgggaaacccgggttacgggtaccgtacggttacggtaaccgtaacggtacgtaaaaccccggtagtaccggttagtacccggagtttcccaccgttaacggtaccg

SEQ ID NO: 17798 - DNA, 837 bp, Homo sapiens
  misc_feature: GYAE6OF01BHTFT.41.81.H04.1.454.CMB.1.raw
  modified_base (146)..(146): a, c, t, g, unknown or other
  misc_feature (146)..(146): n is a, c, g, or t
tcagtctatactatcacgaccggtgctcgatttagtagtgtagattcgcggggagtcagacccactcaggacacagcatggacatgagggtccccgctcagctcctggggctcctgctgctctcggctcccaggcgccagatgtcnccctatccgagatcgaccctagtcctccatcctcactgtctgctatcgtggtaggagacagacgttaccacctattaccgttcggacccggactaacggttcgagggtacctaagtttaaggaaagttcgttaacttttacggtacccgttagggttaacgttaccggaactaaaccggaaaacccggtaacgggaaaaccctcccccgtagaccgtcccttacctacctacttaccgttacgttacctcggtaccttaaccttaccccgtttaaacgtttaaccggaaacgggtttccgggtaacccctagttaaccggtaacggttccgacgggtccggtacgtaggttacggtacgtcggtacgacctaacgttacgtttaccctttacgaccttaccctaaccgtaccacgtaccgtcgtaccgtccgtccgtacgacccgtacgtacgttaacgtaacgtttacctttacgaacctttaactttaacttccgtaacgtaactaaaccggtaacttaaccgttaacccttaacccgttacccggttacgggttttacccgttaccggggaccgttaaacggggaccttacgggtacgttaacggggtaaacctaaaccgttaaaccgggaaaaccgttcgggttacggtacccggtaacccgttccctaaccggttaacccgttcgg

SEQ ID NO: 17799 - DNA, 517 bp, Homo sapiens
  misc_feature: GYAE6OF02GL01N.41.81.H04.1.454.CMB.1.raw
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccggcaagtcagggcattagaaatgattagcctggtatcggcagaaaccaggaaaacgcccctcagctcctcatctgtactgcatccactttacaaaggtcgggtccatacaaggttcagcggcagtggatcgtgcacagtactttcactcncaccatcancagcctgcagcctagaacgttatttcgactaactttatacttgtactacaagtacttactaacttaccgtcgttacgtttcggaccgtacgggaccaggtcgtaggatactaacgaaacgtacgtggtcggtactcgtacacgtac

SEQ ID NO: 17800 - DNA, 579 bp, Homo sapiens
  misc_feature: GYAE6OF02JHV3C.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcacctattactcgccggacaagtcagggcattagaatgattagctgtatcggcagaacaggaaacgccctacacgctcctcactctcgtactgcactccaacttacgaagtcgggtccatacgagtcagcgcagtgatgagtacacgagtagttacacctcttaccacacttcacgaccacgcctgaccgacgtcctaggaagttactttcgacttaactttattacgtactacgtaaacgtaacgttaacttaaccgtaacgtttaacccttcggttaaccgttttacggtaaccgacgggttaccgagggtaccgttaggacggtaactaaccggaaagttaacggttcggttacgcgttaaccgtcgtaaccttacg

SEQ ID NO: 17801 - DNA, 498 bp, Homo sapiens
  misc_feature: GYAE6OF02GGJZ7.41.81.H04.1.454.CMB.1.raw
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaaccaggaaaagcccctcagctcctcatctgtactgcatccactttacaaagtgggtccatcaagttcagcggcagtggatctggcacagatttcactctcaccatcagcagcctgcagcctagaagtattttgactaactttattactgtactaacaagtattaacaatttaaccctggtaacttttggaccagggacctaggctaggagatacaaacgtactgtaggctgctactac

SEQ ID NO: 17802 - DNA, 601 bp, Homo sapiens
  misc_feature: GYAE6OF02GC93O.41.81.H04.1.454.CMB.1.raw
  modified_base (215)..(215): a, c, t, g, unknown or other
  misc_feature (215)..(215): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattactgccggnaagtcagggcatagaatgattagcctggtactcggacaagaaaccgaggaaaacgcccctacacgccttcctacactctgtactcgacactccctaactttaacgaaacggtcgggtacccagtacgaaggttcaggcggacagtggactctcggcacgagtactttacactctacaccgtacacacgacacgcctagaccgtacgtactagaacgttatttacgacttaaacctttagttacttcgtaactaactaagtaacttaacttaactttaacccgtacgttaacgttttcgggaccggtacgggtaccgtacggtcggttaggaacgtaacgtaaccgaaagtaccgtaggtaccggtaccgtacgtaccgtacctacg

SEQ ID NO: 17803 - DNA, 577 bp, Homo sapiens
  misc_feature: GYAE6OF02I5I3Y.41.81.H04.1.454.CMB.1.raw
  modified_base (278)..(278): a, c, t, g, unknown or other
  misc_feature (278)..(278): n is a, c, g, or t
  modified_base (351)..(351): a, c, t, g, unknown or other
  misc_feature (351)..(351): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtaggagacagacgtcaccattacgtgccggcaagtcagggcattagaatgattagcctggtatcggacagaaaccgaaggaaacgcccctanacgactcctcatctgtactgcactacctactttaacgaaggtcggggtacctagtacgaagttacaggacggngagtggtactcgtggacacgagtactttcgactactaccacctagtacacgactacgctagcgtacgccgtagtacgttagtttacacgtaaacttattacgttacgttactaacgtaaagtacttaacttaaccgttacccgttacgtacgtttacgggaccgtacgggaacctggtacgtggaagaacgtacgtaacgtacgtgtacggctacgacgtactacg

SEQ ID NO: 17804 - DNA, 661 bp, Homo sapiens
  misc_feature: GYAE6OF02HH9PA.41.81.H04.1.454.CMB.1.raw
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
  modified_base (643)..(643): a, c, t, g, unknown or other
  misc_feature (643)..(643): n is a, c, g, or t
tcagtctatactatcacgaccggtgctcgatttagtagtgtagattcgcggggagtcagacccactcaggacacagcatggacatgagggtccccgctcagctcctggggctcctgctgctctggcctcccgaggcgccagatgtgccatccagatgacccagtcctccatccctcactgtctgactattcgtaggtacggagaacagacgttccaacctagttaccgttcggaccgggactaacgtcggagggactaaagttaacgaaatgttaagtttacggccgttaggtactcggaacaaacgaaaaccgaaacggaaaaccnccccgtaanaccgtccttacctacgacttcgtagtacctgactacgtacctaacgtttaacgaaggtcggtaccagtacgaaggttcaagggcgacgtaggtagtactcgagacctaagtagttcttacactcaccactanacacgctacgcctgacnccgtacgtagtaaagttcttacgtaactttaacgttactacgttgttaaactaacgtaaagttaccttaactaaccgtttacccgtggttacgttaccgggaaccggtaggtaccgagtacggttaagaactaaccgtaaccgtaagtagtccgggtnaccgtcgaccttcgtacg

SEQ ID NO: 17805 - DNA, 647 bp, Homo sapiens
  misc_feature: GYAE6OF02HSXN6.41.81.H04.1.454.CMB.1.raw
  modified_base (136)..(136): a, c, t, g, unknown or other
  misc_feature (136)..(136): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggccnccagatgtgccatccgagatcgacccagtctccatcctcactgtctgcatctgtaggagacaggatccaccattactggccggnaagtcaggcattagaatgattanctgtangcaagaacagaaacgccctanagtctctcatctgtatgactatccaatttacgaacgtggtaccattacgaagttcgaacgcggctaggtagacttagtacggactacgaacgttattacctaaccgtacttaaccctacctaaaccgtaacaacggaccgtaacgtacccgttaggacccaacgtaacccgtaaggttaacggttaactttttaacggaaccttaaaccgtttactttaacgttaccgttaccgtaactaaacggtaactttaacctaaaccgtttaaccctacggtttacgttttaccgggcgtacgggtaccgtaggtccggtaggaactaacgttaaccgaaacggtaaccgtggttacggaccgtcggaccctaccgtaaccg

SEQ ID NO: 17806 - DNA, 668 bp, Homo sapiens
  misc_feature: GYAE6OF02I193Y.41.81.H04.1.454.CMB.1.raw
  modified_base (330)..(330): a, c, t, g, unknown or other
  misc_feature (330)..(330): n is a, c, g, or t
tcagtctatactatcacgaccggtgctcgatttagtagtgtagattcgcggggagtcagacccactcaggacacagcatggacatgagggtccccgctcagctcctggggctcctgctgctctggctcccaggcgccagatgtgccatccagatgacccagtctccatcctcactgtctgcatctgtagagacagagtcacctattacgtcggccgggacaagtcgagggactaagttaagaaatgtaatttacgccttaggtatcggacaagaaaaccaagggaaaaccgcccctacgaacgtcctaccgtactactcgtacgtaaccncgtaccacttacccgtaactttaacgaaaggttcgggtacccaagtacgtaaggttcaaggcggtactagtcggtactcgaggcaacgtagtactttcactctacctaccatacgagcacgtcctagaccgacgtccgttaagtaagttacgtttacgaacttaacttaactttactagttaaccgtaactaaagtaacttaactaaaccgtttaccccgtacggttaccgtttaccggaccggtaacgggtaccggtaacgggtaacgtagggtaacgtaacgtaaccgtaaaaccggtacggtacggttaccggtactacggtaccgtacctaacg

SEQ ID NO: 17807 - DNA, 676 bp, Homo sapiens
  misc_feature: GYAE6OF02INGNJ.41.81.H04.1.454.CMB.1.raw
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (554)..(554): a, c, t, g, unknown or other
  misc_feature (554)..(554): n is a, c, g, or t
  modified_base (628)..(628): a, c, t, g, unknown or other
  misc_feature (628)..(628): n is a, c, g, or t
  modified_base (635)..(635): a, c, t, g, unknown or other
  misc_feature (635)..(635): n is a, c, g, or t
  modified_base (659)..(659): a, c, t, g, unknown or other
  misc_feature (659)..(659): n is a, c, g, or t
tcagtctatactatcacgaccggtgctcgattttagtagtgtagattcgcgggggaggtcagacccactcaggaccacagcatggacatgaggtccccgctcagctcctgggctcctgctgctctggctcccaggcgccaggatgtgccatccagatgacccagtctccatcctnactgtctgctatctgtacgganacagagttccaacctattaacttgcccggganaagtcgagggccaagtttaagaaatgtaattttagcctgggtaactccggacaacgaaacgagaaaaccgcccctanacgctcctcattctaggtactcgactcgttacctaacgttttaaaccgaacggttccgggttacccaagttacggtaaacggttaccaacgggcccggtaacgtaaagggttccggtaagttaccgttacggaccttaaccggtagttaaccttttccgaaccttactaccctacccagttaccagtacgaacgttcccgaggacctaacggtctaacggttaattacgttttacacgttaaactttntaaccgttagtactaacgtaatacgttaactaccgttacccgttaggttactttcgacggttacggactaggtnaaccggntaacaccgtaaggtactggttacncgtacgacctacggtac

SEQ ID NO: 17808 - DNA, 734 bp, Homo sapiens
  misc_feature: GYAE6OF02GLXN8.41.81.H04.1.454.CMB.1.raw
  modified_base (137)..(137): a, c, t, g, unknown or other
  misc_feature (137)..(137): n is a, c, g, or t
  modified_base (189)..(189): a, c, t, g, unknown or other
  misc_feature (189)..(189): n is a, c, g, or t
  modified_base (243)..(243): a, c, t, g, unknown or other
  misc_feature (243)..(243): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (722)..(722): a, c, t, g, unknown or other
  misc_feature (722)..(722): n is a, c, g, or t
tcagtctatactatcacgaccggtgctcgatttagtagtgtagattcgcgggggagtcagacccactcaggacacagcatggacatgagggtccccgctcagctccgtggggctcctgctgctctggctcccaggcnccagatgtgccatccagatcgaccctagtcctaccacttccctcactcgtcngccagttctaggtacggacgacagtacgtcacctattaccgttggccgggtaanaacgtcggacgggtctaagttaaggaaattgttaacttacgtcgtaggtagcgggactaacgaaaaccgaagggaaacctccccgtanacggccttccctacgagtttcncgttaacgtctcgtaactcctttaacttacggtaacgggttccggacctacacgtacggttcgagtccggaagtcgacggtacgtgtaacggacacggtaagttcttcctacttcccacgtaccctacgtcacggtaaccgcgttccgagtccgaacgttccggtaataacgggtttacttacgtaaactttaaccgttacggttacttacggttacctaaccggaatttaaccttaaccgttaaaccgttcccgttaacgggtttcccggttaccgggtaccgggtaacggtaccggtaccgggttacacggttaactaaccggtaaccgttaaagggtccgtttacggaccgttacgtcgttacccncgttttaaccgg

SEQ ID NO: 17809 - DNA, 695 bp, Homo sapiens
  misc_feature: GYAE6OF02I6E2R.41.81.H04.1.454.CMB.1.raw
  modified_base (489)..(489): a, c, t, g, unknown or other
  misc_feature (489)..(489): n is a, c, g, or t
  modified_base (570)..(570): a, c, t, g, unknown or other
  misc_feature (570)..(570): n is a, c, g, or t
tcagtctatactatcacgaccggtgctcgatttagtagtgtagattcgcggggagtcagacccactcaggacacagcagtggacatgagggtccccgctcagctcctggggctcctgctgctctggcctcccgaggcgccagatgtcgccatccagactcgacccagtcctccagtcctcactgtctcgctacttctggtaggacgacaggaccgtccaacctattacgttccgggaccgggtacaaggtccgaacgggtacttaagttaagaagttcgttaactttacggtaccgttggtaccgtacgggacaaacggaaaccgaaagggaaaccgcccgttacacgtccctccgtactacgtctacggttactcgacttacgtacccttacgtttaacgaacggggttccggtaccctaagttaccggtaacgtccgtacgggtcgtacggtagttacggactcgtacggacacgtacgttacttcnccgttaccactaccgacgtaccacgccgaagttccgacaccggtactagttacgtaacgtttatacgtaacttacgtttanccgttactataacgacttactaccgtaactttccggacgtttacccgtagaccccggtaggtccgacgggtatccgaagacgtttaccgaaacggttagcgggtacgacctacgtacctacttcg

SEQ ID NO: 17810 - DNA, 794 bp, Homo sapiens
  misc_feature: GYAE6OF02HYAYW.41.81.H04.1.454.CMB.1.raw
  modified_base (735)..(735): a, c, t, g, unknown or other
  misc_feature (735)..(735): n is a, c, g, or t
tcagtctatactatcacgaccggtgctcgatttagtagtgtagattcgcggggagtcagacccactcaggacacagcatggacatgagggtccccgctcagctccgtggggctcctgctgctctggctcccaggcgccagatgcgccatccagatgaccctagtctccatccctcactgtctgcatcgtgtaggaagacagatccaacctattacgtcgcgggacaaacgtcgaggtctaaagttagaaactgtatttaacggccgtaggtatcggacaacgaaaaccgtaaggaaaaccgtcccctacgacgcctacctacacttcgtcgttacgagcctaactacctaacgttttaaaccgaaaggttacccggggtaccctaagtaccgtaaacggttacgaaccggcggaaccggtttaggacgtaaccgttccgtaggaaccctacgtaagttaacccggttttaccgtaaccctttacccgtaaccctaaacccgttacgaccctaacgggacccgtaaccgcccgggttaaccacgttaccggtaacccggtaagtttaaacggttattttaaccgaacgtttaaactttaaccgtttacgtcgtttaaaacctaacggtaaactaaaccgttaaccttaacgtttaaacccccggacggtttaaccgggttttaccggacccggaaccgggggtacgtaacccggtaggtttaacgggaaccgtaanaaacccggtaacgttaacggtaaccggtccggttaaaccgccgtaccgtagtttacccg

SEQ ID NO: 17811 - DNA, 921 bp, Homo sapiens
  misc_feature: GYAE6OF02FQDBS.41.81.H04.1.454.CMB.1.raw
tcagtctatactatcacgaccggtgctcgatttagtagtgtagattcgcggggagtcagacccactcaggacacagcatggacatgagggtccccgctcagctccgtggggctcctgctgctctggctcccgaggcgccagatgtgccatccagatcgaccctagtctccatcctcactgtctgcatctggtaaggagacgagacgtacctaacctatttaccgttcggaccggggactaaacggtccgaaggggtacctaaagttaacgaaagttagttaagttttaacgcccgttagggtaacgttccgggaacgtaaacggaaaacccgtaaggaaaacccgtccccttacgaacgtccttacctactacttctaagtccgtctaccgtactacccttaacgtttaactaaagggggttcccggtaacctacgttacgtaaaccgggttccgacggttacccgggagttaggtacgggtaccgttacgtaccgggaaccgtaaacgtacggttacctttacccggtacccttacccgttaacccgtaaccccgtaacttacccggtacggttaacccaccggttacccgtacgaaccccggtaacggtaccggttaacgtttaaacggttttaccgtttaacgttaaacccgtttaaaacgtttttacccgttaaacgtttaaccggtttaaccgttaaaaaccgttaacggtttaaaccctttttaaaccgttaaccccgttttaaacccggggtttaacgttttacccggtttttaacccgggaacccggggtttacccgggtacgggttaccggtaacgggttacggtaaaccttacgggtttaaacccgaaaccgggtttaacgtttccgggtaaaccggtccgttaaccggtacccggttaaaccgtttaccg

SEQ ID NO: 17812 - DNA, 805 bp, Homo sapiens
  misc_feature: GYAE6OF02H50CB.41.81.H04.1.454.CMB.1.raw
tcagtctatactatcacgaccggtgctcgatttagtagtgtagattcgcgggggagtcagacccactcaggacacagcatggacatgagggtccccgctcagctcctggggctcctgctgctctggcctcccaggccgccagatggtcgtccatccagactgacccagtccaccattcctcactgtcctgctatcgtgtaggacgacgagtacgtaccctaactacgtttaacgttcggccccggggtactaacggttaccggacgggtacttaagttaaacgtaaagtacgttaagtttacgacccgttaggtaacgttcggaacgtaacggaaaaccgaaaccgggtaaaaccgcccccgtacaaccggtccccttacctaccgtatccgttagttaaccgtccggtacttaaacccgtttaccgtaaccgtttttaaacgggtaaacgggttccgggggttaacccctaaggtttaaccggttaaaccgggttcgaacgggttccgacggtaaggttcggtaacgtcgttacggactaccgtagttaccttttcgtaaccctttacgtaaccctacgtaaccgtacggtaacgcgtacgccttaccggacgtaccgtacgtaacggtttaacttacgttccgtaatttaaccgtttaactttcggttaacttctaaacgtaacttaacgttaaccttaaacgtttccgttacggttccgtttagggaccgtacgggacgtacggtcgtaaggtacgtagtaaccgaacgtacggttcgacgtccgtacggtcctacgttacg

SEQ ID NO: 17813 - DNA, 833 bp, Homo sapiens
  misc_feature: GYAE6OF02JQ58M.41.81.H04.1.454.CMB.1.raw
  modified_base (186)..(186): a, c, t, g, unknown or other
  misc_feature (186)..(186): n is a, c, g, or t
tcagtctatactatcacgaccggtgctcgatttagtagtgtagattcgcggggagtcagacccactcaggacacagcatggacatgacgggtccccgctcagctccgtggggctcctgctgctctggcctcccgaggcgccagatgtgaccatccgggaaccgacctgccctacgtcttccctacnccttcgtacaacgtctactcgtagtacggaacgtaacgagacgacctaactacttaccggtcggtaccggtacgaacggtacggacggtacgtaagtaactaagttaggtaacttcgtacgttaggaccgtacgacggtaaaccgaacggaaaacggaacccgtaccgaacgcctaccgtcgtacctgtaacctgttaaccttgaacccttacgttaccctaaaagttaccgggtaacccggttcggtaacctaaggggtttccccaaagggttccgaacggtcgtaacggtggtcctaagggtcggaacttaccgaaggtttacctaacgttaccgactttacccgaacgtacccgtacgtaaccacggtaccctacggtaccgtacgtaccgtacggtacgtaacggttaacctttaagttttaaccgtacctttaacgttacgtttaacgtacgttaacctttaaacggtaactttacccgttaacgttaaccgtttacccggtaaccgggttaacccggttacgggacccgttaacgggggtcccgttaagggtacccgtagggtaaaccgttccccggaaaggttaacggtccgtacgggtacttacggtaccgttacccgttaacgtcctttacgtacccg

SEQ ID NO: 17814 - DNA, 627 bp, Homo sapiens
  misc_feature: GYAE6OF01D3QOE.33.21.B10.1.454.CMB.1.raw
  modified_base (188)..(188): a, c, t, g, unknown or other
  misc_feature (188)..(188): n is a, c, g, or t
  modified_base (425)..(425): a, c, t, g, unknown or other
  misc_feature (425)..(425): n is a, c, g, or t
tcagtacacacactcacgaccggtgctcgatttagtgtcgtcgcaagggggggtacgtacggaagggaaggcagcgcttcgtccgggacgtctaccaccagtggccctgggctctgctattcctcccctcctcactcagggcacacggtcctgggccccagtactgccctgactcaacctgcctcgtntcctgggtctcctggacagtcgggtcaccatcctcctgccgctggaaccgagtagtgacattggtaggttatcaccgtgtctcctagtaccaacacacccaggcacagccccaaatcatactttatgaggtcactaagccggacctcgacgggtccctgactcgccttctctggtctccaagtctgacgaacaccggcctcctacgaccgtcctcgtcggcctccaggctcgaacgntcggaacgtctagtatttattacttgtactagttcaagtaccggagaccaaacgtaacaactcgttcttacgttcggtacggtacgggtaccacggacgttacgaacggttaccgtaagtaccgaagaccccgaaggtctccggtcccccgttcggtccaaccgttccgttacgttccccccgtcccttcccgtcgtaccgg

SEQ ID NO: 17815 - DNA, 538 bp, Homo sapiens
  misc_feature: GYAE6OF01A4TOE.33.21.B10.1.454.CMB.1.raw
tcagtacacacactcacgaccggtgctcgatttagtgtcgtcgcaagggggggtctcaggaggcagcgctctcgggacgtctccaccatggcctgggctctgctattcctcccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaagcccccaattattgatttctgatgtcactaatcgccctcaggggtttctcatcgcttctctggctccaagtctggcagcacggcctccctgacccactctctgggctccaggctgaggacgaggctgtttatactgctgcccgtatacattcagcagctctctcgtaagttccgacgggtaggaccaaggtgaccgtcttaacgtcacgtcccaaggcctcgccccccgtcggtccacctactcgttccccgtacccctcccg

SEQ ID NO: 17816 - DNA, 599 bp, Homo sapiens
  misc_feature: GYAE6OF01AZU82.33.21.B10.1.454.CMB.1.raw
tcagtacacacactcacgaccggtgctcgatttagtgtcgtcgcaaggggggggtctcaggaggcagcgctctcgggacgtctccaccatgacctgggctctgctattcctcccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaacgcccccaattattgatttctgatgtcactaatcggccctcagggtttctcatcgtcttctctgctcaagtctggcagcacggcctcctgaccatctctggctcaggctggaggacgagtctgtttattacgtgctcgcccttatacctagttcacgctagtcctcgtcgtacgtaaagttcgggacggtaacgggaccgtaagggtccgtaaccggttacgttaaacggttacgaaccggtacccgaaacgggtcccgtacccggtccccccgttacggtacctacccgttaccgttcccgttccccctacccgttaccccg

SEQ ID NO: 17817 - DNA, 534 bp, Homo sapiens
  misc_feature: GYAE6OF01BLW60.33.21.B10.1.454.CMB.1.raw
  modified_base (518)..(518): a, c, t, g, unknown or other
  misc_feature (518)..(518): n is a, c, g, or t
tcagtacacacactcacgaccggtgctcgatttagtgtcgtcgcaagggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaaagcccccaattattgatttctgatgtcactaatcggccctcagggtttctcatcgcttctctggctccaagtctgcagcacggcctcctgaccatctctgggctccgaggctgaggacgaggcttagtttattactgctgctcatatactattcagtagtgtatctactaagttcgggacgggggaccagtcgctcgaccgtccgtaagtcacggcccaaggcctcgtccccctcggtaccncgttctcgttaccccc

SEQ ID NO: 17818 - DNA, 569 bp, Homo sapiens
  misc_feature: GYAE6OF01BNHD5.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctgtaccaacaacaacctggacaaacgcccccaattattgatttctgatgtcactaatcggccctcgtaggggtttctcatcgtcttctctggctcaagtctgcagcgacggcctccgtcgaccactctcgtgggcctccgaggtctggacggacgaggtcttagtttattacgtgtctcgtaccgtatactattcagcagctctctacgtaagttcgggacggacgggaccaaggtcgaccgttactaacgtcgacgacccgaaggtcctaccgtcccccgtcggtcctacttccgtccgttccccgcccttcccg

SEQ ID NO: 17819 - DNA, 574 bp, Homo sapiens
  misc_feature: GYAE6OF01EPB7G.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctctggtaccaacaacaacctggcaaagccccccaattattgatttctgtatgtcactaatcggccctcgaggggtttctcatcgcttctctggctccaagtctggcagcgaccggcctcccgtgacccatcctcgtcgggctccaggctggaggacgaggtcttgtttatactgtctcgccctatacattcagcagctctcgtcgtaagttcggacggacggaccgaaggtcgaccgttacttaagtcgacgtacccgaacggcctacccggcccccgttccggtaccacccgttcgttccgtttccccctaccccgtttaccg

SEQ ID NO: 17820 - DNA, 896 bp, Homo sapiens
  misc_feature: GYAE6OF01CTWSL.33.21.B10.1.454.CMB.1.raw
tcagtacacacactcacgaccggtgctcgatttagtgtcgtcgcaagggggggtctcaggaggcagcgctctcgggacgtctccaccatggcctgggctctgctactccctcccctcctcactcgaggcacgacggtccgtcgggcccgagtctcgccctgacctaccaacctcgcccgtccgtgtcgtggtcctcgtggacgtaggtccggtaccacctatcctccgtcgccgtcgtacggaaacctaggttagtcggtacggttgggacggtctagtcgtaacttagtcgtccttccgtacgtaaccaaaccgaaacctaaccgtcggaaccaaacccgacccccctaaatttacgttagttactttcgtagtagttcgtacctaacttaacgtcccggtcccttacgggttacggggttttcctacgtacgttcccggttcctttccgtcgtccggtaccttaccgtaaacgttccgttacgggaccgacggtacccggaacccggtcccccttcccgtaccgtaacccgtaacgttcccgttccggtacgggtcccttaccgggtaacgggtccgtagggaaccggggtaaccggtacgggttacgtttagtttttaaccgtaccgttcgtacccgttccggtaaccccgttaacgttaacttaccgtttacgaaccgtccgtaacgttcccttaccgttccgtaaccggttaacggttcccggggaaccgggtaaccgggtacccggtaaacgggtccggttaaccccgttaaacggttaaccgtaccggtaacccggtaccccgaacggtccccgttccccggtaccccccggttacggtaccccttaaccgttcccgtttaccccgtccccctacccccgttaccccgg

SEQ ID NO: 17821 - DNA, 667 bp, Homo sapiens
  misc_feature: GYAE6OF01BBGN4.33.21.B10.1.454.CMB.1.raw
  modified_base (220)..(220): a, c, t, g, unknown or other
  misc_feature (220)..(220): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacaggtcctgggcccagtctgccctgactcaacctgcctccgtgtctgggtctcctggacagtcggtcaccatctcctgcgctggaaccngtagtgacgttggagctatgactatgtctctgtaccaacaacaacctggcaaagcccccaattattgatttctgtatgtcactaatccggccctcaggggtttctcatcgtcttctcgtgctccaagtctggcagcacggtcctccctgaccatcctcgtcgggcctccgaggtctaggacgggacgtacggtcttaggttttattacgtagccttcggtcccgtatacctattccgagtacctacgtcctaccgttccgttacgtaacgtttccggggaccgggtacgggtaacccgtaagggtccgtaacccggttacgtttaaacggtccgtaaccggtaccccgtaaacgggtccgttaccccggtacccccccggtttacgggtaccccgttaacccgttcccggtttaccccggtttccccccgtcccccgtttacccccg

SEQ ID NO: 17822 - DNA, 642 bp, Homo sapiens
  misc_feature: GYAE6OF01EHIEO.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaactacccagacagacgccccccaactcttagtattttgatgtctactttatccggccctcgaggtacgtttctctattcgtttctctggcctccagtctggctagtaccgccctccctgacctatctcgtcgggcctccgaggtcgtacggaccggacgtacggtcttcgtttacttcgtgtctgtcctactacttactactattacgtagttacgtgtactctaacgtaaacggttcgggggaccgggggtacctagtacgtcgtacggtacccgtaccgtaacggtaccgaacggtaccccgtaaggtcccgttcccggcccccgttcggtaccctaccttcccgttacccgttccccctccccgttcccgtaccg

SEQ ID NO: 17823 - DNA, 774 bp, Homo sapiens
  misc_feature: GYAE6OF01D83ZN.33.21.B10.1.454.CMB.1.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagtacacacactcacgaccggtgctcgatttagtgtcgtcgcaaggggggggtctcgtaggaggcagcgtactctcgggacgtctccacgatcggcctgggctctgcgtattcctccctcctcactcgaggcacagggtcctgggccagtctgcctgactcaacctgcctcgtntctgggtctctggacagtcggtcaccatcctcctggcgctggaaccnggtagtgaacgttggagtctangactatgtctcgtgtacaacaacactggacaacgccccaattactagactttctgtactgtacaactaaacgtccggaccctacgtacggggtttctactactccgtctttactacgtcggtaccttaccgtaaacgtcgtacgggaccacggccgaacggtccctcccgttacggtaaccctaattccgttccgttacggggaccttacccggaaggtccgttacgggaaacggggtaccggtaaagggttcgttttacgggtttaactttaccgtacgggttacccgttaccgggttaccccgttaacgttaaccgttaaccgtttacgaaccggtcctaacggtccttaccgttaccgttaaccgtaacggtttaccgggaccgggttaacgggtaacccgttaaacgggtccggtaacccggtccgttaacgggtccgaaacgggacccgtaacgggtccctaacccggtccccccgttacgggtaccacccgttccgttacccggttccccgccctttacccgg

SEQ ID NO: 17824 - DNA, 557 bp, Homo sapiens
  misc_feature: GYAE6OF01B3LP3.33.21.B10.1.454.CMB.1.raw
  modified_base (297)..(297): a, c, t, g, unknown or other
  misc_feature (297)..(297): n is a, c, g, or t
tcagtacacacactcacgaccggtgctcgatttagtgtcgtcgcaagggggggtctcaggaggcagcgctctcgggacgtctccaccatggcctgggctctgctattcctcccctcctcactcagggcacagggtcctgggcccagtctgccctgactcaacctgcctccgtgtctgggtctcctggacagtcggtcaccatcctcctgcgctggaaccagtagtgacgttggaggctatgactatgtctcctggtaccaacaacaacctggacaaacgcccccaattatgatttcngatgtcactatcgcctcagggtttctcatcgcttctctggctccaagtctggcagcacggcctcctgaccatctcgtggcctccgaggctgacgggacgacggtctttgtttaattactcggtcttcggtcccgttaatacactttcagcacgtcctctctacgtacttcgggacggagggaccgaaggtcgaccgttctaaaggtcacgacccaaggcctccggcccctcggtccactcctcgttccccgcccttcccg

SEQ ID NO: 17825 - DNA, 725 bp, Homo sapiens
  misc_feature: GYAE6OF01CZIQM.33.21.B10.1.454.CMB.1.raw
  modified_base (288)..(288): a, c, t, g, unknown or other
  misc_feature (288)..(288): n is a, c, g, or t
tcagtacacacactcacgaccggtgctcgatttagtgtcgtcgcaaggggggggtctcaggaggcagcgctctcgggacgtctccaccatggcctgggctctgctattcctcaccctcctcactcagggcacagggtcctgggcccagcctgccctgactcagcctccctccgcgtccgggtctcctggacagtcagtcaccatctcctgcactggaaccagcagtgacattggtgttatcacgtgtctctgtaccaacacaccagcacacgccccaatcatacttangagtcactaagccgcctcgacgggtccctgactcgcttctcgtggcctacaagtctgaacacacggtcctccgtgacccgtcgtccgtcggccttacccgacggtctacggaccgtagtacggacgggtcttcggttaatttaacggtttactttgacccttaaggttttaccgaacgttaaccggggtaacgggtaacaaaaccgtaaacgttaaacctttacccgtttaaccggttttaacggtaccggggtcgggtaaaccgggtaacccctaagggtccttaaacccgggtaaccccttaccggtaaaccgttacccgaaccgggtaaccccctaaacgggtccccgttacccgggtacccccccctttgggtaacccctaacccggttcccctttaccccgggttaccccccgtcccccgtttaacccccgg

SEQ ID NO: 17826 - DNA, 767 bp, Homo sapiens
  misc_feature: GYAE6OF01D0S1M.33.21.B10.1.454.CMB.1.raw
  modified_base (219)..(219): a, c, t, g, unknown or other
  misc_feature (219)..(219): n is a, c, g, or t
tcagtacacacactcacgaccggtgctcgatttagtgtcgtcgcaaggggggggtctcaggaggcagcgctctcgggacgtctccaccatggcctgggctctgctattcctcccctcctcactcagggcacagggtcctgggcccagtctgccctgactcaacctgcctccgtgtctggtctcctggacagtcggtcaccatctctgcgctaggaaccngtagtgacggttggagctatgactatgtcctcgtagtaaccaacaacaaccgtggacaaaccgccccctaaattacttagtactttacctagtacttcgtactaacgttaaacgtcccggtaccccgttacggttacggggttttcctaccgtacttacctaacctttccgtccgtcgggtcctaccgtaacggttcgttacgggacctaacggacccgtaacccgggtcccctttacccgtacggtaacccctacgttcccgttccggtacgggtcccttacccgacgggtccgttacgggacgggtaaccggtacgggttacgtttacggttttaacgttacggttacgtccgttacccggtacccgtttaacgtaccgttacgttaccgtacgaccgtacgtcccttaccgttaccgtacgttaaccgggttcgggaccggtaacgggaaccgttaacgggtaccgtaccgttacgtaacgtcgaccggtaccgtaacggctcccggtccccgtcgtcctactccgtccttccccgaccttcccg

SEQ ID NO: 17827 - DNA, 634 bp, Homo sapiens
  misc_feature: GYAE6OF01BED65.33.21.B10.1.454.CMB.1.raw
  modified_base (202)..(202): a, c, t, g, unknown or other
  misc_feature (202)..(202): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctcgtgtctgggtctcctggacagtcggtcaccntctcctgcgctggaaccagtagtgacgttggagctatgactatgtcctcctggtaccaacaacaacctggacaaacgcccccaatttacttgtatttctagattgtctactaatccggtccctcgtaggggtttctactatcgtcttctctcggcctacctaagtctggctagaccgaccggccctcccgtacgacctactcctcgtcgggtcctccgaggtcgtaggacggacggtaggtcttagtttactacgtgcgtcgtacccgttatactacttacagtctacgtctctcgtacggtacgttcgggacggaacgggtaccgaaggtcgtaaccgttacgttaacgtccgacgacccgtaacggtccgtacccggtcccccgtacggtcctacccgttccgttcccggttccccgtccccttacccgg

SEQ ID NO: 17828 - DNA, 673 bp, Homo sapiens
  misc_feature: GYAE6OF01BJ7MS.33.21.B10.1.454.CMB.1.raw
tcagtacacacactcacgaccggtgctcgatttagtgtcgtcgcaagggggggtctcaggaggcagcgctctcgggacgtctccacatggcctgggctctgctattcctcccctctcactcagggcacagggtcctgggcccagtctgccctgactcaacctgcctccgtgtctggtctcctggacagtcggtcaccatctcctgcgctggaaccagtagtgacgttggagtctagtgactatgtctctagtaccaacaacaacctggacaaacgaccccctaattacttagtactttctagtaatcgtacaacttaaacgtccggtacccttacggtaacggggttttcctacgtaacgttccgtccgtttcgttccgtcggtccctaccgtaacgtccgtacggtcgacgtccgaaccggtccctacccgtcgaaccgtacttccgtcgtcgggtcctaccgtacggtcgtcggaacgggacggtaagtcgtttacgttacgttaccgtgtcgtacgttcccgtaatacgtactcgacgtactacgtcctcttcgtacgttacgtccgggacggacggaccgtaaggtctaaccgttcgttaacgccgacgtccgtaacggtcctacccggtcccgtcgtacctaccgtcgtacccgtcccgtccgtcccg

SEQ ID NO: 17829 - DNA, 619 bp, Homo sapiens
  misc_feature: GYAE6OF01DJ4BT.33.21.B10.1.454.CMB.1.raw
tcagtacacacactcacgaccggtgctcgatttagtgtcgtcgcaagggggggtctcaggaggcagcgctctcgggacgtctccaccatggcctgggctctgctattccctcccctctcactcagggcacagggtcctgggcccagtctgccctgactcaacctgcctccgtgtctgggtctcctggacagtccggtcaccatcctcctgcgctggaaccagtagtgacgttggagtctatgactatcgtctccgtagtaccaaacaacaacctggacaaacgcccccaattacttagtatttctgtatgtacaactaactccggccctcgtaacggggtttctcgtatcgtcttctcgtcgtctacctaagttcctggcagccaccggccctcctcgacctactctcgtcggctccaggtctagagggtacgaggtcttagtttaactacttgcctcggtcccgtaatactattcgagtccagtcctctcgtcgaattcgggcggacggtaccgaaggtcgaccgttacgttaaggtccaacggtcccgaaggtccctaaccgtcccccggttacggtaccctacgttccctcccggtttacccccacccgttacccg

SEQ ID NO: 17830 - DNA, 583 bp, Homo sapiens
  misc_feature: GYAE6OF01DRGKB.33.21.B10.1.454.CMB.1.raw
  modified_base (455)..(455): a, c, t, g, unknown or other
  misc_feature (455)..(455): n is a, c, g, or t
  modified_base (533)..(533): a, c, t, g, unknown or other
  misc_feature (533)..(533): n is a, c, g, or t
tcagtacacacactcacgaccggtgctcgatttagtgtcgtcgcaaggggggggtctcaggaggcagcgctctcgggacgtctccaccatgacctgggctctgctattcctccccctcctcactcaggcacagggtcctgggcccagtctgccctgactcaacctgcctccgtgtctgggtctcctggacagtcggtcaccatctcctgcgctggaaccagtagtgacgttggaggctatgactatgtcctctggtaaccaacaaacaacctggacaaaccgccccctaatttatgtatttctgatgtacaactaacgtccggcctcgtagggtttctcagtcgtcttctctgctcagtctgcagcacggcctccgtacgacctactctcgtcggcctccgaggtctggagggacgagtcttgtttaacttgtcgctcgtccgtatactattcangactcgttctacgtcgtacgtcgggacggaggtacacgggtctaccgttacgttaacgcgaaccgaccggtagtcccncccggtccccgttacgtcctaccttccgtccccttcccgtccccttaccg

SEQ ID NO: 17831 - DNA, 808 bp, Homo sapiens
  misc_feature: GYAE6OF01BVNWP.33.21.B10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
tcagtacacacactcacgaccggtgctcgatttagtgtcgtcgcaaggggggggtctcgtaggaggcagcgtctctcgggaccgtctccaccatggcctgggctctgctagttcctcccctcctcactcagggcacgagggtcctgggccctagtctcgccctgactcgaacctgcctccgtgtctggtctctggacngtcgtcacntctctgcgcgtgacagtagtgacgttggaggctagngtactatgtctcgtgtaccaacgaacaccgtggtacaaaccgacccctaattacttagtactttactacgtactacgtacctactaacgtccggtaccctacggtacggggtttctacgtactcggtctttccgtctcggtccgtaccgtaagtccgtaggtcgtacggtacgtaccggtacccgttccccgtcgtaacctacgttccgttaccggtccgggtaccgttaaccggtacggtaaccgttgggtaacgggtaacggtacgggttcgttttacgtttaacgtttaacgttcgttccggtaccggttaccccgtaacgttaaccgtaccgttaccgtacgaccgtacgtccgtttacccttcgttaacccggtaacggttcccgggtaaccggggaacggggtaacccgttaacgggtacccggttaacccggttacccgttaaccgggtaccggtacccgtaacccggtaccgggtcccgtaccccggtaccccccggttacccgggttaccaaccccgtttcccggtaccccggttccccgtcccccggttacccgg

SEQ ID NO: 17832 - DNA, 686 bp, Homo sapiens
  misc_feature: GYAE6OF01A26VO.33.21.B10.1.454.CMB.1.raw
  modified_base (194)..(194): a, c, t, g, unknown or other
  misc_feature (194)..(194): n is a, c, g, or t
  modified_base (302)..(302): a, c, t, g, unknown or other
  misc_feature (302)..(302): n is a, c, g, or t
tcagtacacacactcacgaccggtgctcgatttagtgtcgtcgcaagggggggtctcgaggaggcagcgctctcgggacgtctccaccatggcctgggctctgctacttccctccccctcctcactcagggcacagggtcctgggcccagtctgccctgactcaacctcgcctccgtgtctggtctcctggacngtcgtcacatctctgccgctggaacctagtagtgacgttggagctagtgactagtgtcctcgtagaccaacaacacgcgacaaccgaccctaattatatattctagtntacgtactactacgtccgtccgtcgtacggttctcgtacgtcgtcttcgtcgtcgtacctacgtacgtcgacgaccgtaccgtaccgtccctccgtacgtccgttcgtcgtccggtacctacgtacggtacgtacggtacgtacgtacggtacggttacgttagttatttacgttagttacgtacgttacgtacgtaacgtaacggacgtaacgtaactaacttacgttaccgttacggttacggtacgggtaaccggtaacgtaaccgtacgtaccgtaccgtaccgtacgtaacgtaccgaccgtaccgtacgtcccgtccccgttaccccgtaccgtacccgtaccgttcccgttaccccgttcccctcccgtaccgtacg

SEQ ID NO: 17833 - DNA, 801 bp, Homo sapiens
  misc_feature: GYAE6OF01BBF51.33.21.B10.1.454.CMB.1.raw
tcagtacacacactcacgaccggtgctcgatttagtgtcgtcgcaagggggggggtctcaggaggcagcgctctcgggacgtctccaccatggcctgggctctgctattcctcccctcctcactcagggcacagggtcctgggcccagtctcgcctgactcaacctgcctcgtgtctggtctccgtggacagtcgtcaccatctctgcgctaggaacagtagtgacgttggagctagtgactagtcgtcctacgtacgtaaccaacaaccaaccgtagaccaaaccgaccccctaatttacttacgtactttctagacttcgtactactaacgtccggtacccgttacggtacgggtttcctacgtacgttccgttacctttccgttacgttcggtacccttaccggtaaacggtttccggttacgggtccgtaaccggtcccgtaacccgggtcccccttacccgtaccgtaaccctacgttaccttccggtacgggtcccttaccggaacggtcgtacgggaacggtacgggtacggttacgtttacgttttaacgttacgtacgtccgtaccggttacccgttaacgtacgttaccgtacgaccgtcgtacgtccgttacttaccggtacggttacggtccggggttaacggaccgggtaacggtaacggttaccggtaccgtttaaccgtaacggtaccggtaccgtaacccggtaccggtcccgtacccccgtacccggttacccggttaccgtacccgtttcccgttaccccgttccccgtccccgttacccggg

SEQ ID NO: 17834 - DNA, 657 bp, Homo sapiens
  misc_feature: GYAE6OF01AI12H.33.21.B10.1.454.CMB.1.raw
tcagtacacacactcacgaccggtgctcgatttagtgtcgtcgcaaggggggggtctcaggaggcagcgctctcgggacgtcttcaccatggcctgggctctgctattcctccccctcctcactcagggcacagggtcctgggcccagtctgccctgactcaacctgcctccgtgtctgggtctcctggacagtcggtcaccatctcctgcgctggaaccagccgtgacgttggtggttataagtatgtctcctggtaccaacagcacccaggaccaaacgcccccaaactcttagtatttatgaggtcacgtgacgccggccctcgacggggtccctgtactcgtcttctctgctccagtctggacaacgcgtcctcccgtacgaccctatccgtcgtcgggcctcgacggctggaggagtcggacggtcttagtaacgtttaacgtacgtggcgtacgtcgtaccgttagcggacgacgggaccggtaactaaacgttaagggttttacggggtcgggttaccggggacgggtaacgggaaccgtaacgggtcgtaacccgtcgtaaccgacgtaccggacccgaacggtccctcccggtccccgtcggtaccccgtacccgttccccgttacccctccccttccgtccgtacgg

SEQ ID NO: 17835 - DNA, 647 bp, Homo sapiens
  misc_feature: GYAE6OF01B5UKW.33.21.B10.1.454.CMB.1.raw
  modified_base (192)..(192): a, c, t, g, unknown or other
  misc_feature (192)..(192): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacngtcggtcaccatctcctgcgctggaaccagtagtgacgttggaggctatgactatgtctcctggtaccaacaacaacctggacaaaacgcccccaattattgtatttctgatgtcactaactcggccctcgtaggggtttctcatcgtcttctcgtggctaccaagtctggcagcgaccggccctccctgaccactctcgtcggctccgacggtctggacggacggaggtcttggtttacttacgtgtcgttcgtacccgttaattaactactttcgacgacgtacggtccttaccgtccgttacgtaaccgtttcgggacggggtacgggaaccgtaacgggttcgtaaccggttacgttaaacggtccgaaccggacccgtaaggcccgttcccggccccccgttcgggtaccctaccgttacccgttcccgtttcccccgtaccccttcccg

SEQ ID NO: 17836 - DNA, 678 bp, Homo sapiens
  misc_feature: GYAE6OF01BD1A4.33.21.B10.1.454.CMB.1.raw
  modified_base (652)..(652): a, c, t, g, unknown or other
  misc_feature (652)..(652): n is a, c, g, or t
tcagtacacacactcacgaccggtgctcgatttagtgtcgtcgcaaggggggggtctcaggaggcagcgctctcgggacgtctccaccatggcctgggctctgctattccctccccctcctcactcagggcacagggtcctgggcccagtctgccctgactcaacctgcctccgtgtctgggtctcctggacagtcggtcaccatctcctgcgctggaaccagtagtgtacgttggaggtctatgactatgtctccgtgtaccaacaacaacgtcgacaaaccgccccctaattattgtatttctgtatgtactaacttaacgtccggtcccttcggtacggggttttctacgtacgttcgtcctttctccgttcggtacccttaccgtaacgttccgtcggaccgacgacccgaccggtcccctcccgtacgaccctacgttccgttaccggtccgggtaccctacccggtacggtccgtaagggacgggacggtacgggttacgtttagttttacttacgtcgtccgttcgtaccccgttaatactcttacacgcctcgtccttctacgtacgtagtccgggacggacggtaccgtaggtcgtacttacgtacgccgacgtaccgtacggtccacccgtcccgtcgtccncttcctcccgttcccctcccgttccg

SEQ ID NO: 17837 - DNA, 750 bp, Homo sapiens
  misc_feature: GYAE6OF01EYMVU.33.21.B10.1.454.CMB.1.raw
  modified_base (203)..(203): a, c, t, g, unknown or other
  misc_feature (203)..(203): n is a, c, g, or t
tcagtacacacactcacgaccggtgctcgatttagtgtcgtcgcaaggggggggtctcaggaggcagcgctctcgggacgtctccaccatggcctgggctctgctattcctcccctcctcactcagggcacagggtcctgggcccagtcctgccctgactcaacctgcctccgtgtctgggtctccgtggacagtcgtcaccntcctcctgcgcctggaacctagtagtgacggttggacggtctagtcgactatgtcctccgtaggtaccaaaccaactaaccgtggaccaaaaccggccccctaaattacttacgtatttctagtacttcggtcctaacgttaacgtccggtcccgtacgtaacggggttttcctcgttacgtccgtctttacttcgtcggtcctaccgtaaacgtcgtacggctagaccgtacccggtccctcccgtacgaaccctattcctacggtcgggtccttacccggaggtcgtacgggaggaccggtacgggtacttacggttttataccggttcgtcctacgttaccccgttataacctacttaccgaacgtccacggtcttaccgttccgtagtaacggttccgggacgggtaaccgggaacgtaaacgggtccggttaacggttaccttaaacgggtccgaacggtacccggaacgggtcccgacccgttcccccggtaccgttacccggtaccttaccggttccccttaccccctccccgttacccg

SEQ ID NO: 17838 - DNA, 782 bp, Homo sapiens
  misc_feature: GYAE6OF01DANM0.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattccctccccctcctcactcagggcacagggtcctgggcccagtctgccctgaccttcaacctgccctccgtgtcgtgggtctcctggacagtccggtcaccattcctcctgcgctacggaaccaggtagtcgacggttggaggacttagtgaactagtcgtctccgtaggtaacccaaactaaaccaaccgtggaaccaaaacccgtaccccctaaattttacttacgttactttcgtagtattacgttacctaacgttaacgttcccggtacccgttacggttacggggttttacctacgtacttccgttcctttccgtaccgttccgtccttaccgtaacggttccgtcggtacgacgtaccgtacccggtccctcccgtacgtacccgtactcccgttacggtccgggtaccctccggaacgtcggtacgggaacgggtacgtacgggttctttacggtttaactcgttcgaccggttaccgtacccttacgtaacgttcttaaccgagtcctacgtccttccgttacgtaccggtacggtaccgggacgggacggtaccggtacggtccgtaacgttaccgtaagtccgaaccggtaccgtaacggtcccgtaccccgtccccgttacggtacccttccgttcccgttccccgtcccgtcccccgttccgg

SEQ ID NO: 17839 - DNA, 724 bp, Homo sapiens
  misc_feature: GYAE6OF01DWYQB.33.21.B10.1.454.CMB.1.raw
  modified_base (605)..(605): a, c, t, g, unknown or other
  misc_feature (605)..(605): n is a, c, g, or t
  modified_base (687)..(687): a, c, t, g, unknown or other
  misc_feature (687)..(687): n is a, c, g, or t
  modified_base (696)..(696): a, c, t, g, unknown or other
  misc_feature (696)..(696): n is a, c, g, or t
  modified_base (703)..(703): a, c, t, g, unknown or other
  misc_feature (703)..(703): n is a, c, g, or t
  modified_base (719)..(719): a, c, t, g, unknown or other
  misc_feature (719)..(719): n is a, c, g, or t
tcagtacacacactcacgaccggtgctcgatttagtgtcgtcgcaaggggggggtctcaggaggcagcgctctcgggacgtctccaccatggcctgggctctgctattcctcccctctcactcagggcacagggtcctgggcccagtctgccctgactcaacctgcctcgtgtctgggtctcctggacagtcggtcacctatctcctggcgtctacggaacctgtagtgtacgttggacgtctagtcgaacttgtcgtcctacgtaggtaacctaacaaccgtaaccgtggaccaaaaccggccccctaaatttacgttacgtaactttcctagtattacggttacctaacttaacgtccccggtaccgtaccggtttacggggtttctaccgtaacgtttcccgttcgtttaccgtcgtcggtctacccgtagttccgttcggaactcggccgtacccggtacccgttcccgtaacggtacctaaccggttccttaccggtccggggtacccttaccggtaccggtcgtaggtaacccgggagtacggttacgtttacggtttaactacgtcggtctaccgtccgtaattacgtcttacgtacncgtcgccttacgtcgtacgtagtccggacgggtaacggacgtaacggtctacgttacgtaccgcgaccggttacacggtccncccgtaccncgttacnccgttacctcttcccnctccg

SEQ ID NO: 17840 - DNA, 834 bp, Homo sapiens
  misc_feature: GYAE6OF01CKYWO.33.21.B10.1.454.CMB.1.raw
  modified_base (489)..(489): a, c, t, g, unknown or other
  misc_feature (489)..(489): n is a, c, g, or t
  modified_base (752)..(752): a, c, t, g, unknown or other
  misc_feature (752)..(752): n is a, c, g, or t
tcagtacacacactcacgaccggtgctcgatttagtgtcgtcgcaaggggggggtctcaggaggcagcgctctcgggacgtctccaccatggcctgggctctgctatccctcccctcctcactcagggcactaggtcctggccagtctgccctgactcaacctgcctccgtgtctgggtcctcctggacctagtccggtacacctactctcctgccgtacgtacggaaaccaggttacgtcggtaacggtttgggaacggtctaagttggaacctttagtccggttaccttacccggtacgggttaaaccctaaaacctaaaccggtaaaccgtaccgggaaccctaaaacccggtaccccccttaaagtttactttacgtaactttctacggtacgttacgtacctaacgtaccgtccggtacccgtacgttacgggtttactacgtacgttcgtcttctcgtaccgcttccgtacgtcgtacgtcgngacccgtaccggtaccctccgtacaccgtacttcgttcggtaccgggtcctacggtaaccgggtcgaaccgggtaaccgggtacggttacggttagttttaccggttttactaaccgttcggtcccgttaaccggttaacccgtaacgttaaccgttacctttaaccgggactacggtacgtttccccgtaacgtccggttaacgggttccgtacgggtaaccgggtacggtaccgtaacggtccgtacgttaccggttaacnccggtaccgtacccggtacggtaccccttcccggtcccgtaacgttccctaccgttaccggtccccgtccccgtccggtccg

SEQ ID NO: 17841 - DNA, 521 bp, Homo sapiens
  misc_feature: GYAE6OF02GZZ6W.33.21.B10.1.454.CMB.1.raw
  modified_base (466)..(466): a, c, t, g, unknown or other
  misc_feature (466)..(466): n is a, c, g, or t
tcagtacacacactcacgaccggtgctcgatttagtgtcgtcgcaaggggggggtctcaggaggcagcgctctcgggacgtctccaccatgacctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaagcccccaattatgatttctgatgtcactaatcggccctcagggtttctcatcgcttctctggctcaagtctggcagcacggcctccctgaccatctctgggctccaggctgaggacgaggctgtttatactgctgcccgtatacattcagcagctctctcgaattcggcgagggaccaaggtgaccgtnttagtcacgaccaaggcctcgccccgtcggtctacctctcgttcccacccttccg

SEQ ID NO: 17842 - DNA, 543 bp, Homo sapiens
  misc_feature: GYAE6OF02I9E5F.33.21.B10.1.454.CMB.1.raw
  modified_base (369)..(369): a, c, t, g, unknown or other
  misc_feature (369)..(369): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaacgccccccaattattgatttctgatgtcactaatcggccctcaggggtttctcatcgcttctctggctccaagtctggcagcacggcctccngaccatctctgggctccaggctgaggcgaggcttgtttattactgctgccgtatactattcagcagctctctcgtaattcggacggaggaccgaaggtcgaccgttcgttaagtcaacgcccaaggtcctcgcccccttacggtcctaccgttcgtccgttcccgcccttcccg

SEQ ID NO: 17843 - DNA, 553 bp, Homo sapiens
  misc_feature: GYAE6OF02GZJYR.33.21.B10.1.454.CMB.1.raw
  modified_base (299)..(299): a, c, t, g, unknown or other
  misc_feature (299)..(299): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagcctgccctgactcagcctccctccgcgtccgggtctcctggacagtcagtcaccatctcctgcactggaaccagcagtgacattggtgttatcactgtgtctcctggtaccaacaacacccaggcacacgacccccaaactcatactttangaggtcactaagccggccctcgacgggtccctgactcgcttctctggctcaagtatgacaacaccgcctcctgacccgtctcgtcgggcctccgaggctgacgagtggaggtctgtatttattattgactagttcagtacggagacaaacaacaattctcttacgtcggacggaggaccagctcgaccgtactagcgaacgcccgaaggcctaccgcccctcggtcctaccttccgtccgttccccgccttccg

SEQ ID NO: 17844 - DNA, 601 bp, Homo sapiens
  misc_feature: GYAE6OF02INNWV.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaacgcccccaattacttgatttctgatgtcactaatcggccctcgaggggtttctcatcgcttctctggtctccaagtctggcagcacggcctcctgaccatctcgtgggctccgaggctggaggacgaggtcttgtttattactcgctcggcccgttatactattcagcagcttcctctacgtaacgttcgggaccgggtaacgggaccgaagggttcgtacccgttcgttaacggtccgaacggtaccccgaagggtccctaccggtccccccgttacgggttacctaccgttcccgttccgttacccccgtaccccgttcccg

SEQ ID NO: 17845 - DNA, 549 bp, Homo sapiens
  misc_feature: GYAE6OF02GENY6.33.21.B10.1.454.CMB.1.raw
  modified_base (358)..(358): a, c, t, g, unknown or other
  misc_feature (358)..(358): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagcctgccctgactcagcctccctccgcgtccgggtctcctggacagtcagtcaccatctcctgcactggaaccagcagtgactattggtgttatcactgtgtctcctggtaccaacaacacccaggcacagcccccaaatcatactttatgaggtcactaagcggccctcgagggtccctgatcgcttctctggctccaagtatgacaacncggcctcctgaccgtctctgggcctccaggctgacgatggagctgatttattatgctagttcagttacggagacaacaactaatcttcttagttcggacggaggaccaagctacgaccgtactaagtcgacgacccgaaggtcctccgcccccgtcggtccaccgttcgtccgtttccccgcccttacccg

SEQ ID NO: 17846 - DNA, 568 bp, Homo sapiens
  misc_feature: GYAE6OF02G7NNB.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaacgccccccaattattgatttctgatgtcactaatcgccctcaggggtttctcatcgcttctctggctccaagtctggcagcaccggccctccctcgacctacgtcctcgtcgggcctccgaggctggacggacgaggtcttgtttacttactgctcgtcccgtataccattcagcagccttctactcgaagttcggacggacgggaccaagggtcgaccgttacgttaacgtcgacgcccgaaggtccgtaccgccccgtacgtcctacctcctccgttcccacccttccc

SEQ ID NO: 17847 - DNA, 535 bp, Homo sapiens
  misc_feature: GYAE6OF02JFSQS.33.21.B10.1.454.CMB.1.raw
  modified_base (426)..(426): a, c, t, g, unknown or other
  misc_feature (426)..(426): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctgtaccaacaacaacctggcaaagccccccaattattgatttctgatgtcactaatcggccctcaggggtttctcatcgcttctctggctccaagtctggcagcacggcctcctgaccatctctggctccaggctgaggacgaggtctgtttattactgctgcccgtatactnttcagcagctctctcgtaagttcggcggaggaccgtaaggtcgtaccgtacttaagtcaacgcccaaggctcgcccctcggtccaccttctccgttccctacccttccg

SEQ ID NO: 17848 - DNA, 550 bp, Homo sapiens
  misc_feature: GYAE6OF02F3LY7.33.21.B10.1.454.CMB.1.raw
  modified_base (403)..(403): a, c, t, g, unknown or other
  misc_feature (403)..(403): n is a, c, g, or t
tcagtacacacactcacgaccggtgctcgatttagtgtcgtcgcaagggggggggtctcaggaggcagcgctctcgggacgtctccaccatggcctgggctctgctattcctccccctcctcactcagggcacagggtcctgggcccagtctgccctgactcaacctgcctccgtgtctgggtctcttggacagtcggtcaccatctcctgcgctggaaccagtagtgacgttggagctatgactatgtctcctggtaccaacaacaacctggcaaagccccccaattattgatttctgatgtcactaatcggccctcagggtttctcatcgcttctctggctccaagtctggcagcacggcctccctgacccatcctcgtgggcctccgaggctgaggacgnggctgtttatactgctgcccgtatcattcagtcagctctcgtacgtagttcggcggacggaccgaaggtcgaccgttctaagcgaacggacccaaggccgtccgcccccgttcggtcctaccttcgtccgttccccaccccttcccg

SEQ ID NO: 17849 - DNA, 605 bp, Homo sapiens
  misc_feature: GYAE6OF02HZB1Q.33.21.B10.1.454.CMB.1.raw
tcagtacacacactcacgaccggtgctcgatttagtgtcgtcgcaagggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaacgcccccaattatgatttctgtatgtcaacttaactcggccctcgtacggggtttctcgtactccgtcttctctggtcctaccgaagttctggcagcaccggtcctcctcgaccatcctctcgggctccgaggctggacggacgaggtcttgtttatactgctcgtcccgtatactattcgagcagtctctctcgtaacgttcggcggtacgggactaagggtcgtaccgttacgttaacgtcgaacgtccccgtaaggtcccgtacccggtcccccgttcggttacccacccgtttaccgttcccgtttccccaccccgttccccg

SEQ ID NO: 17850 - DNA, 672 bp, Homo sapiens
  misc_feature: GYAE6OF02HUQGT.33.21.B10.1.454.CMB.1.raw
  modified_base (190)..(190): a, c, t, g, unknown or other
  misc_feature (190)..(190): n is a, c, g, or t
tcagtacacacactcacgaccggtgctcgatttagtgtcgtcgcaagggggggtctcaggaggcagcgctctcgggacgtctccaccatggcctgggctctgctattcctccccctcctcactcagggcacagggtcctgggcccagtctgccctgactcaacctgcctccgtgtctgggtctctggacngtcggtcaccatctcctgcgctggaaccagtagtgacgttggaggctatgactatgtctctggtaccaacaacacctggacaaacgccccctaattactgtatttctgatgtactactaacgtccggtccctcgtacgggtttctactatcgtcttctcgtcggtcctacctaagtcgtggcacgcgtaccggccctcccgtcgacctacttacctcggtcgggtcctaccgacggtccgtaggacgggacgacgggttcttaggttttaactacgtcgtccgttccggtacccgttactactacgttcgacgtctacgtccttccgtacgtacgtaacgttccgggacgggaacgggtaaccgtaacgggtacgtacccgttacgttaacgtccgtaacggtacccgtaacgggtccgtacccggcccccgtacggacccctaccgttacccgttccgttacccccgtccccgttacccgg

SEQ ID NO: 17851 - DNA, 698 bp, Homo sapiens
  misc_feature: GYAE6OF02I54M8.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattccctccccctcctcactcagggcacagggtcctgggcccagtctgccctgactcaacctgcctccgtgtctgggtctcctggacagtcggtcaccatctcctgcgctgggaaccagtagtgacgttggaggctatgactatgtcctccgtggtaccaacaacaacctgacaaacgcccccaattattgtattctgatgtcactaactccggtccctcgtagggtttctcgtatcgcttctctggctccaagtctgcagtcgacggccctcctcgaccgtactccgttacgtcgggccttccgaggtccgtacggacgggtaccggaggtacgttcggttttacttacgtcgtacgtcggtacccgttaattaccgtagttccgagtcctaacggtcctaccgttcgtaccgtaacggtttacccggggacgggtaacggggtacccggtaaagggtcggttaaccccgttacgtttaacggtaccgtaaccggtaccccgtaaagggtcccgttcccggtaccccccgtttaccgggttaccctacccgtttccgttcccggtttaccccccgtcccccgtttaccccgg

SEQ ID NO: 17852 - DNA, 689 bp, Homo sapiens
  misc_feature: GYAE6OF02IUQ5M.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctaggaaccagtagtgacgttggaggctatgactatcgtcctccgtggtaaccaacaaacctaaccgtggaccaaaacgaccccccaatttattagtatttctagattggtcaacttaacgtccggccctcggtacggggtttcctacgattccgtactttctccgtcggtcctcctaagtctggacacggacgaccggtccctacctcgaccattcctcgtcggtcctccgacgtcgtaggacggaacgaggtcctttaggttttaacttacgtcgtccgttccggttacccgttaattaaccgtacttacgacgtactacgcttccttacgtacgtaaggttccgggacgggtacggaccgtaaagggtcgtaccgttacttaacggtaccgtaccgacccgtaaggtcccgtaccggtccccgttaccggtaccttaccgttcccgtaccgtttaccccctacccttaccccgg

SEQ ID NO: 17853 - DNA, 872 bp, Homo sapiens
  misc_feature: GYAE6OF02F7WP4.33.21.B10.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
tcagtacacacactcacgaccggtgctcgatttagtgtcgtcgcaagggggggggtctcaggaggcagcgctctcgggacgtctccaccatggcctgggctctgctattcctcccctcctcactcagggcacagggtcctgggcccagtctgccctgactcaacctgcctccgtgtctgggtctcctggacagtcggtcaccatctcctgcgctggaaccngtagtgacgttggagctangactagtcgtctccgtaggtaccaacaacaacctggacaaaacgacccccctaaattattacgtaattttcgtagaacttgtactaacgtaaataccgggccctacggtacggggttttctaccgtaagttcggtactttccgttacgttacgggtaccttacccgtaaagttccgttacggaccgttaacggaccgtaaacccgggtccctttaccccgggttacgaaaccctaaacgttcccgttcggttaccggggtacccttacccggaacgggtcccgtttaacgggaacgggtaaccgggtaacgggtaaccgttttaacggttttaacgtttaaaccgttcggtaccgtttaccgggtaaccccggtttaaacgttaaccttaacgttaaccgttaaacgggaccttaaaccgtccggtttacccttacgtttaaccggttaaacggtttacccggggttaaaccgggaacgggtaaaccgtaaacggggttaccgtaaccggtttacgtttaaacggtaccggtaaccggtaacccggtaaacgggtccgttaccccgggtccccttacgggttacccttacccgttaccgttacccggtttaccccctacccctttaacccgg

SEQ ID NO: 17854 - DNA, 607 bp, Homo sapiens
  misc_feature: GYAE6OF02HIOY5.33.21.B10.1.454.CMB.1.raw
  modified_base (293)..(293): a, c, t, g, unknown or other
  misc_feature (293)..(293): n is a, c, g, or t
tcagtacacacactcacgaccggtgctcgatttagtgtcgtcgcaagggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctctagtaccaacaacactgacaacgcccccaattatgattcngatgtcactaatccgaccctcgtacgggtttctctactcgtcttctcgtcgtctaccaagtctggctgccacgtccctcctcgaccacttctcgtcggtcctccgagtcgtaggacggacggtacggcttaggtttaacttcgtacgtcgtcgtacccgtatactacttcgacgcacgtcctcctacgtacgtaaggttccggacgggtaaccgggacgtaagggtcgtaccgttacgttagtccgtaacgccggacgtaccgttcccggaccccgttcgtacctaccttccgtacccgttccctacccttccg

SEQ ID NO: 17855 - DNA, 656 bp, Homo sapiens
  misc_feature: GYAE6OF02JHHLG.33.21.B10.1.454.CMB.1.raw
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
tcagtacacacactcacgaccggtgctcgatttagtgtcgtcgcaagggggggtctcaggaggcagcgctctcgggacgtctccaccatggcctgggctctgctattcctccccctcctcactcagggcacagggtcctgggcccagtctgccctgactcaacctgcctccgtgtctggtctcgtgacagtcggtcaccatctctgcgctaggaaccagtagtgtacgttggagctatgactatgtctctgacacaacactganaacgcctaatntgtattntnatgtacactactcgcctgtaggttctcactcgtcttcgtacgtcgtcttaccgaagtcgtagtacaacgtaccgtaaccggccttaccgtacgtaacctacgttcgtaccggtcgggtacccgtacgacggtaccgtagggtaaccggtacgggacgggttacgttacgttttaacgtaccgtggttaccgtaccggtacccttaagtaacctacgttcaacggtacctacggtacctcgttcctaacggtaacgttccgggaccggttaagggaaccgaaagggtccgttaaccgtacttacgacgtaccggcctaaggtccgtacgtcccgtacgtaccgtacgtccgttccgttcccctaccgttaccg

SEQ ID NO: 17856 - DNA, 693 bp, Homo sapiens
  misc_feature: GYAE6OF02H62QX.33.21.B10.1.454.CMB.1.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctcgtgtctggtctcctggacagtcggtcaccatctcctgcgctggaaccngtagngacgttggaggctatgactatgtctccgtggtaccaacgaacaacctgaccaaacgcccccctaattattagatttactgtatggtcacttaatcggtccctcgaggggtttctacatacgtcttctctcggctcaagtctggcacgtcacggcctcctacgacctatctcgtggtcctaccgaggtcctagggacgaccggaggtccgttagtttacgttaacgtcggtccgttcggtacccggttaataaccgttatttccgaacgaccgtacgtaccgttcccttaccgtaccggtaaacggtttccggggaccgggtaacgggaaacccgtaaaggggttaccgtaacccggtttacgttaacggttaccgaaccggtacccccgggtaaggttaccccgtccggttccccccgtacggttccctaaccgtcccgtttccggttacccccgtccccttaccccgg

SEQ ID NO: 17857 - DNA, 672 bp, Homo sapiens
  misc_feature: GYAE6OF02I7WH4.33.21.B10.1.454.CMB.1.raw
  modified_base (399)..(399): a, c, t, g, unknown or other
  misc_feature (399)..(399): n is a, c, g, or t
  modified_base (520)..(520): a, c, t, g, unknown or other
  misc_feature (520)..(520): n is a, c, g, or t
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatcctcctgccgctaggaaccaggtgtgacggttgggaggtctaatgacttatgtcctcctggtaccaacaacaacctggacaaacgccccctaattattgtatttctgtatggttaccacttaacgtccggtcccctcgtacggggtttcctctactccgtctttcgtcgtcggtcctaccgacgttcgtggtacncgccgacggtcctcccgtacgaccctactccgtcgtcgggtctaccgaggtctacggacggacgtaggtcgttgtttacttacgtcgcgttaccgtaccgttatacgtacttacgacgtcncgtcttcgtacgtacgtacgttcgggacggtaccggacgtacggtacgtaccgttacgttacgtaccgacggtaccggtaacggtccgtacccggtacccccgttcggttaccctaccgttaccggtacccgttcccccggtcttaccccgg

SEQ ID NO: 17858 - DNA, 624 bp, Homo sapiens
  misc_feature: GYAE6OF02FPTHL.33.21.B10.1.454.CMB.1.raw
tcagtacacacactcacgaccggtgctcgatttagtgtcgtcgcaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatcgtctccgtggtaccaacaacaacctggcaaacgccccccaattacttgatttctgatgtacactaatcggccctcgagggtttctcatcgtcttctctggtctccagtctggcagcacggcctccctgacctatcctctcgggcctccgaggtcctggacgggacgaggtcttggtttaacttaccgtggtccttcggtcccgtattacctacttctacgctacggtctccgttctcgtaagtttccgggacgggtaacggacgtaagggtacgaccgttcgttaacgtccgaacggtcccaaagggtcccttaccggtccccccgttcgggttacctacccgttccttaccggtttccccccaccccgttccccg

SEQ ID NO: 17859 - DNA, 802 bp, Homo sapiens
  misc_feature: GYAE6OF02FXGHQ.33.21.B10.1.454.CMB.1.raw
  modified_base (172)..(172): a, c, t, g, unknown or other
  misc_feature (172)..(172): n is a, c, g, or t
  modified_base (261)..(261): a, c, t, g, unknown or other
  misc_feature (261)..(261): n is a, c, g, or t
tcagtacacacactcacgaccggtgctcgatttagtgtcgtcgcaaggggggggtctcaggaggcagcgctctcgggacgtctccaccatggcctgggctctgctattcctcccctctcactcaggcacagggtcctgggcccagtctgccctgactcaacctgcttccgtntctggtctcctggacagtcggtcaccatctcctgcgctggaaccagtagtgacgttggaggtctatgactagtgtctccgtgtaccaanaaccaactgacaaacgcccccaattactgtattctgatgtctaactaatccggcctacgtacggggtttctcgtaatcgtcttactcgtcggcttaccgtaagtcgtcggactacgtccaacggtccctacccgtacgtaccgtacttaccgtacgtcgggtaccgttacccgaacgggtccgttacgggacgggtaaccggtacggttcttacggttttaaacttaaccgtcggtaccgttccggtaaccccgttaagttaaccttacgttacgaacggtaccgtaacgttacccgttacgttaccgtaccgttaaacggtttccggggtaacggggtaaccggggtaaacccgtaaagggggttaccggtaaacccggtttacgtttaaaaccggtaaccggtaacccgggtaaaccccggtaaaccgggttccccgttaaccccggttacccccccggtttacggtttaccccgtaaaccccggttttcccggtttacccccggtttaccccccgttccccggttttaaccccccggg

SEQ ID NO: 17860 - DNA, 625 bp, Homo sapiens
  misc_feature: GYAE6OF02F28UT.33.21.B10.1.454.CMB.1.raw
tcagtacacacactcacgaccggtgctcgatttagtgtcgtcgcaaggggggtctcgaggaggcagcgctctcgggacgtctccaccatggcctgggctctgctattcctcccctctcactcagggcacagggtcctgggcccagtctcgccctgactcaacctgcctccgtgtctggtctccgtggacagtcggtcaccatctctgcgctggaacctgtagtgacgttggagtctatgactatcgtctccgtagtaccaacaactacgtacgacaaccgtaccctaattactagtacttactacgtatacgtactactacgtccgtcctacgtcggttactctacgtcgtcttcgtcgtcgtactacgtacgtcgtcgacgacgtccgtacgtcctcctactactacgtctcgtcgtactacgacgtcgtacggtacggacgtacgtacttagttaacgtacgtcgtcgtcgtacgtacgtactagtcgatacgtcgtctacgtacgtacgtacggtacggtacggtacgtacgtagtaccgtacgttacgtacgtacgaacgtaccgtacggtccgtaccgcccgtaccgacctaccgttccgttacccgtcccgtacccgtc

SEQ ID NO: 17861 - DNA, 192 bp, Homo sapiens
  misc_feature: GYAE6OF01DNUI5.43.70.G04.1.454.CMB.1.raw
  modified_base (191)..(192): a, c, t, g, unknown or other
  misc_feature (191)..(192): n is a, c, g, or t
tcagtgtgagtagtcacgaccggtgctcgatttagtgtagtgtgaagggaaagggcagtatcaccgcgttccggcacggattctgacttagaggcgttcagccattatccggcagatggtagcgtcgcggcactgcctggtcaaggactacttccactactcacactgagcgggctggcaaggcgcatagnn

SEQ ID NO: 17862 - DNA, 192 bp, Homo sapiens; identical to SEQ ID NO: 17861
  misc_feature: GYAE6OF01CFUFO.43.70.G04.1.454.CMB.1.raw
  modified_base (191)..(192): a, c, t, g, unknown or other
  misc_feature (191)..(192): n is a, c, g, or t

SEQ ID NO: 17863 - DNA, 617 bp, Homo sapiens
  misc_feature: GYAE6OF01C4LH4.43.70.G04.1.454.CMB.1.raw
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
tcagtgtgagtagtcacgaccggtgctcgatttagtgtagtgtgaaggaaaggcacgaaccgggtcgactcgactttagtggtagtgtcgaagggaaaggggctctgggagacggagcccccagcccgtggacgagttcccaggtgtttccctattcgagtgatcagcactgacacagacggactcaccagtggagttgggactgagttggtattttcctttggctattttaaaaggngtccaggtcgtgaagttgctaggttggtggaatcgtgggggagcttggtacagccttggtcaggtccctgagtactcgtcctgtgcgacgctcgtgtattcgagtctttgggntattangccatgacacgtgggtccgnaggggtccaaggggaacggtcctagggacgtgggtctacgaaagtnttagcgagggatagtgatacccgagctacgcgactcgtagtggaacgggctagtccgacctatctacctagacgaacaaccgacctaaacgtaaccttcccttagtactcgtacgacaaaagttcgtaaacctaggtacctaggtacgtacgtcgttagaaccggtaaccgaccgggtccctgttacgtttacg

SEQ ID NO: 17864 - DNA, 573 bp, Homo sapiens
  misc_feature: GYAE6OF01BUDAH.43.70.G04.1.454.CMB.1.raw
  modified_base (326)..(326): a, c, t, g, unknown or other
  misc_feature (326)..(326): n is a, c, g, or t
  modified_base (467)..(467): a, c, t, g, unknown or other
  misc_feature (467)..(467): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttattttaaaaggtgtccagtgtgaagtgcagttggtggaatcgtgggggaggcttggtacagcctggcaggtccctgagactctcctgtgcagcctctgggattcagtctttggngtattatgccatgcacgtcggggtccgcgacggggtccgaggggaacgggccgtgggaggttgggtctacgtaaggttattaggcgtaggggatagtgactacccgtaggctacgcggactcgtgtggagggcattcactntctcagagacaacgaccaacgaccttccctagtactctcgactaaatcgaaactgttactggaacgagcgtaggaacggaccacccggtcccttcgttatttccgg

SEQ ID NO: 17865 - DNA, 612 bp, Homo sapiens
  misc_feature: GYAE6OF01BO9P2.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttccttttggctattttaaaaggtgtccagtgtgaagtgcagttggtggaatcgtgggggaggcttggtacagcctggcaggtccctgagactctcctgtgcacgcctctggattcagtctttggtgtattatgccatcgcacgtcggggtccggcgaggggtccgaggggacggccgtgggagtggggtctacgaagttagttaggcgtagggtataggtagaactacccgtaggcctacggcggtactcgtggtaggaagggtctattcaccatcctaccgaagacgaaccaaccgaccaaacgtaaccttcccgtagtactcctagactaaatacggaaactcggtacgtacggaaggacgtacgtagggaaccggaccgtaacccgggtccccttgttaactttccgg

SEQ ID NO: 17866 - DNA, 531 bp, Homo sapiens
  misc_feature: GYAE6OF01B470Q.43.70.G04.1.454.CMB.1.raw
  modified_base (443)..(443): a, c, t, g, unknown or other
  misc_feature (443)..(443): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttccttttggctattttaaaaggtgtccagtgtgaagtgcagttggtggaatcgtgggggaggcttggtacagcctggcaggtccctgagactctcctgtgcagcctctggattcagtctttggtgtattatgccatgcacgtgggtccgcgagggtccgagggacggctggagtggtctgaagtattagcgagggtatagtgactacctaggctacgcgactcgtgtgagggcatcacatcncagagacaacgaccaagacctcctgtactactgacaaatagaacgtagtctaggagagctagacggacaccggcccttagtcgtttcg

SEQ ID NO: 17867 - DNA, 192 bp, Homo sapiens; identical to SEQ ID NO: 17861
  misc_feature: GYAE6OF01A1QCA.43.70.G04.1.454.CMB.1.raw
  modified_base (191)..(192): a, c, t, g, unknown or other
  misc_feature (191)..(192): n is a, c, g, or t

SEQ ID NO: 17868 - DNA, 627 bp, Homo sapiens
  misc_feature: GYAE6OF01CAQVX.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggtattttccttttggcttattttaaaaggtgtccagtgtgaagtgcagttggtggaatcgtgggggagcttggtacagcctggcaggtccctgagactctcctgtgcagcctcgtggattcagtctttggtgtattatgccattcgctacgtgggtacccgcgtacggggtccgaagggggaacggtccgtagggaggttcggggtactacgtaaagttagtttacgacgtagggtataggtgtaactaccgtaggcctacggcggactcgtaggtggaagggctatccactactcctaccgagacgaaccaaccgaccgaacgtaacctccctagtactaccgtagaacaaagtcgaaacgtacgttacgaggtaacgaggtacgtacgggaacgggaaccctaccgggtccccttgttaacgtttccgg

SEQ ID NO: 17869 - DNA, 758 bp, Homo sapiens
  misc_feature: GYAE6OF01BSXIV.43.70.G04.1.454.CMB.1.raw
  modified_base (337)..(337): a, c, t, g, unknown or other
  misc_feature (337)..(337): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagcccccagccctgagattcccaggtgtttccattcagtgatcagcactgaacacagaggactcaccatggagttgggactgagttggattttcctttggcttattttaaaaggtgtccagtgtgaagtgcagttggtggaatcgtgggggagcttggtacagcctggcaggtcccctgagacctctcctgtcgcagcctcgtgggactttcgagtcgttttgggtntaagtttatcgccagttgcctacgtcgggtccggcgaggggtcccgaggggaacggccgtgggagttcggggtactacgaagttagttacggacgtaggggtataggtacgtaacttacccgtagggtacctaccggccgggtaacttcggtaggtacggggtaaacgggggtccgtaacgtttaccgaacccgtaacgttcccggttaacccaaggtaacgaacccgtaaacccggtaaccctaaacgggtaaacccctttccccgtaaggttaacctttacccgtacggtaacctaaaaacgttaccggtaaaaccgtacggttacccggttaaggaacgggtaaaccgtccgggttaacggtaaccgggtaacccgtaacccgggttccccccgttaagtttacccggtttttaccgg

SEQ ID NO: 17870 - DNA, 681 bp, Homo sapiens
  misc_feature: GYAE6OF01CWB57.43.70.G04.1.454.CMB.1.raw
  modified_base (226)..(226): a, c, t, g, unknown or other
  misc_feature (226)..(226): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggtattttccgtttggcttagttttaaaggngtccagtgtgaagtgctagttggtaggaatcgtgggggagtcttgggtacagtcctggctaggtccctgaagtcctctcctgtacgcaggccctgtggtactttcgngtctttggngtattatgcctatcggaccacgtgggtcccggnacggggtccaggggaacggtcgtggtaggtcggtactacgtaaagtgttagcggtagggtataggtacgaacgtaccgtaggccgttacggcggtaactcgtaggtacgggaacgggggtactacgtaccgtaaccgtacttacccgtaccgaacgtaacgaaaccggtaaacccgaccgtaaaccgtacccgttacctaaggtactaccgtacgtaaacctaaagttacggaaacgtcgttaccgaaggtaacgacggtcgtacggaacggtacccgtaaccggtccccttacgttagtttaccg

SEQ ID NO: 17871 - DNA, 843 bp, Homo sapiens
  misc_feature: GYAE6OF01CI5T4.43.70.G04.1.454.CMB.1.raw
  modified_base (237)..(237): a, c, t, g, unknown or other
  misc_feature (237)..(237): n is a, c, g, or t
tcagtgtgagtagtcacgaccggtgctcgatttagtgtagtgtgaagggaaagggcacgaccggtgctcgatttagtgtagtgtggaagggaaaggggctcgtgggagaggacgccccagccctgagacttcccgaggttgtttccattcagtgatcagcactgaacacagacggactcaccagtggagttggactgtagtttgttattttccgttttggacttaagtttaaaggtntcgagttgtagaagtgcgtaggttggtaggaacgttcggtagggggagtcgtttaggtacacggtccgtggaccgtacggtccctaggacgtacccttccgttccgtggtcgcgtacgtcccttggtacggtacttcgtagtttcggtttaggtgttattacgtcgtaccgtagttcggaccgttaccgggttcggggtacccggtacggtaccggggttacgggaacgggggaccggttccgggtagggttacgggttccggttacctaaaccggttaaagtttacggttaacgggacggtaaaggggttactaacgggttaccgtaacgtttaccccggtaaggtcccgttaaccggtaccggtacgttccggttaagggtcgggtaaacgggtaccgttacgttacccaaccgtaccgtttaccgaaccgaacggaaaccgaacccggtaaacccgaaacccgtaaacgttaccccgttacccgttaattaccgttacggtaccgtaaaccaaagttaccggaaccgttaggtacgtacgaaggtaccgtacggaacggtaaccgggaccccgttacccgttacctttagtttaccgttacgg

SEQ ID NO: 17872 - DNA, 695 bp, Homo sapiens
  misc_feature: GYAE6OF01EOCZ8.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagcccccagccctgagattcccaggtgtttccattcagtgatcagcactgaacacagaggactcaccatggagttgggactgagttggtattttcctttggcttaattttaaaaggtgtccagtgtgaagtgcagttggtggaatcgtgggggaggtcgttggtacagcctggcacggtccctggacgactcctcctgtcgcacgtcctcgtggtacttcgagtcgtttggtgtagtttactcgcctagttcgaccgtacggttcggggtcccggcggtacggggtcccggaaggggggtaacgggtccgtaggggtacgggttcggggtcttacggtaaaggtttagttacggacggaaggggtataacggttagaccttaaccgtaggtaccgttaccggacggtacttcggtcggtacgggtaagggtcctaacgttccacccgtatcccaaccgtaggaacgtaacccaaccgaccgaaacgtacccgtacccttagtacctcgtaacacgtaaacgataacgtcgtagtacgaaggtacgaccgagggacgtaacccgacccggtcccttgttcgttacg

SEQ ID NO: 17873 - DNA, 769 bp, Homo sapiens
  misc_feature: GYAE6OF01DHAYJ.43.70.G04.1.454.CMB.1.raw
tcagtgtgagtagtcacgaccggtgctcgatttagtgtagtgtgaagggaaaggcacgaccggtgctcgatttagtgtagtgtggaagggaaaggggctcgtgggagaggacgcccccagccctgagtattcccgaggtgtttccattcagtgatcagcactgaacacagagactcacatggagtggactgtgttggtattttccgtttggctttaagtttaaaggtgtcagtgtagaagtgcgtagttggtagtagtcggtgggggagtcgttggtacgacggccgtggctacggtcccgtagaacgtcttccgtcgtgtcgctacgtcccgtgtacggtcttaccgtggttcgtttaggagttacttagtgtacccgtagtcgtccggtacggtccggggtccggacggtacgggtacggaggggtacggtcggtgggtcggttagggtacctaacggttaagttacgttaacggacggtaaggttacgtaggttaccgtaacgttaccgtacggtaccgtacggtaccgtacggttcgtacgggaacgggtaccgggtacttaacccgttcgaacccttcggtaccgaaccgacggtaaaccgaacccgaaccgaacccgtaaaacggtccccgttaccgtttaacgtacggttaaccctaaggaacccttaaagtaacccggtaagtcgttacggtaggacgtacgttcggaacggtaacccgggtaaccgtccccggtttaacctttacgttaacgtttccggg

SEQ ID NO: 17874 - DNA, 800 bp, Homo sapiens
  misc_feature: GYAE6OF01BMLX9.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagacttcccaggtgtttccattcagtgatcagcactgaacacagaggactcaccagtggagttgggactgtaggttggtatttttccgttttggactttaagttttaaaaaggtcgtacctaggttgtagaaggttgcgtaggtttgggtggaagtcggtggggggaggtcgttggtacacggccgtggcgacggttccctggacgtaccttcgttccgttggtcgccacggtcccgttcgtcgggtactttccgaggttcggttttggtgttagtttacgtcgtccctagtccgacgtacccgggttcgggtccggaccggtacggggtaccggaaggggggaaccgggtccgtagggtacgggttcgggttacgtacgtaaaggtttacgttacgggacggtagggtagtaggtacgtaaccgttacccggaggtaccctacggtacgtacgttcggtacggtagggaacgggtccgtaacgttacccaccgtaccttccgacccggaagtaacgaacccgaaaccgtacccgtaaaccgtaccctttaccgtacgttaaccgtcgtaacgtaaacctaaacgtaaacggtacgtaaccgtacggtaaggacggtacggtacgtaacgggtaacggaccccgtaacccggtttcccgttactttcgtttaaccgg

SEQ ID NO: 17875 - DNA, 829 bp, Homo sapiens
  misc_feature: GYAE6OF01BPXBJ.43.70.G04.1.454.CMB.1.raw
tcagtgtgagtagtcacgaccggtgctcgatttagtgtagtgtgaagggaaagggcacgaccggtgctcgatttagtgtagtgtgaagggaaaggggctctgggagaggagccccagccctgagattcccaggtgtttccattcagtgatcagcactgaacacagaggactcaccatggagttgggactgtagttggtattttccgtttggtactttaagttttaaaaggtgtcctagttgtagaagtgcgtaggttggtggaagttcggtgggggaggtcgtttggtacgacggccgttgggaccgtacggttcccctaggacgtaccttccgttcccgttggtcgccgtacggtcccttcggtaggtacttcgtacggtttcgttttaggtacgtattttacgtcgtaccgtagtcggaccgtcgggttcggggtcccggtacggtaacgggggtaccggaagggggtacgggtccggtaggggtagggtcggtactacgtaaaggttagttaccggaggtaagggtagttaacggtacggtaacgttacccggtacggtaccgtaaccggacggtaacgtcgtaggtacgggaacgggtacgttacgtaccgaccgtaccgtaccgttaaccgaacggtaaccgaacccggtaaacccgaacccgtaaaccgtaaccccgtttacccggttaacgttaccgtaccgtaacgtaaaccgtaaacgtaacgtaaacggtacgttacggtacggtaacggtacggtaacgtaacgggtaaccggtaacccggttaccccggtaccgtttaaccgtttacgtttaaccgg

SEQ ID NO: 17876 - DNA, 590 bp, Homo sapiens
  misc_feature: GYAE6OF01BKI3L.43.70.G04.1.454.CMB.1.raw
  modified_base (490)..(490): a, c, t, g, unknown or other
  misc_feature (490)..(490): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggtattttccttttggcttattttaaaaggtgtccagtgtgaagtgcagttggtggaatcgtagggggaggtcttggtacagcctggcaggtccctgacgctctctgtgcagtcctgtggtattcgagtcgtttggtagtattatcgcctagttcgacctacggtcgggtccgacggtacgggtaccgaggggaacgggtccgtgggaggttcgggtctacgaagttgtagcgagggtataggtgaacctacctaggctaacggcggtactgtgaggaagggctatccacatccncagacgaaccacgaccaacgacctctagtactcgnactaaanacgaacgtacgtcaggcgacgtgtacgtacggaccgtaccgtcccttagttcgttacg

SEQ ID NO: 17877 - DNA, 726 bp, Homo sapiens
  misc_feature: GYAE6OF01DNQJA.43.70.G04.1.454.CMB.1.raw
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagcccccagcccctgagacttcccaggtcgtttccattcagtgatcagcactgaacacagagactcaccagtggagttgggactggagttggtatttttccgttttggtacttaagtttttaaaaggtgtaccgtaaggttgtagaagttcgacgtaggttgggtaggtaagtcggtggggggtaggtcgtttgggtaacaggtccgtggcgtacggtcccgtaggacgtaccttccgtccgtgtcgcacgtcctgtgnttcngttcgtttggtgttattntcgtacatgccacggtcggccggcgacggggtccgaagggacggcgtggnggtcggtcacgtaagtagtacggcgtaagggtgtagtcgtacgtaccgtaggtcgtacgtcgtagttcgtggtacgggagggtcgtactcgaacctacgtctaccgagtaacgaaccgaccgtaccgtaaacgtaacccttacctaggttactaccgtagtaaccctaaaaggtaccgtaaacgtacgttaccggtaggtaaaccggtaccgggttacgtaacgggtaaacccgggtacccgggtaaccccggttaccctttacccggtttacgttttaaccggg

SEQ ID NO: 17878 - DNA, 767 bp, Homo sapiens
  misc_feature: GYAE6OF01AWJA9.43.70.G04.1.454.CMB.1.raw
  modified_base (184)..(184): a, c, t, g, unknown or other
  misc_feature (184)..(184): n is a, c, g, or t
  modified_base (544)..(544): a, c, t, g, unknown or other
  misc_feature (544)..(544): n is a, c, g, or t
tcagtgtgagtagtcacgaccggtgctcgatttagtgtagtgtgaagggaaaggcacgaccggtgctcgatttagtgtagtgtgaagggaaaggggctcgtgggagaggacgccccagccctgacgtattcccgaggtgtttccattcagtgatcagcactgaacacagagactcaccagtggngttggactgtagtttggttattttccgtttgtacttaagtttaaaagtgtacctagtgtagaagtgtcgtagttggtaggagttcggtggggtagtcgttggtacgacgcgtggcgtacggtcccgtagacgtactcctcgtagtcacgtcgtacctcgtagtacttcgtcggtttacgttttggtacgtagtttctcgacctgttacgccgtaccggtcgggtaccggtaccgtacgggacggtacggggaacggtccggttagggtcggttacggtacgtaaccgtagtttacggtaggacggttaagggtacgtaaggtacgtaccgtacggaacggttaccgtaacggaccggttntaccgtagggtaccgggtaacggtacttaaccgtacgaaccgtccgttacctaccgaaacggaacgtaaccccgaacgtaaaccctaaaccgtaaaccccgttccgttaacgtacgttcaaacgtaacccgttaagttaaacccgaacgttacggtaaccgttaggactcggttaaacggccgggttaacgacccgttacccgtctttacgtacgtttaacgg

SEQ ID NO: 17879 - DNA, 856 bp, Homo sapiens
  misc_feature: GYAE6OF01B5ASR.43.70.G04.1.454.CMB.1.raw
tcagtgtgagtagtcacgaccggtgctcgatttagtgtagtgtgaagggaaagggcacgaccggtgctcgatttagtgtagtgtggaagggaaagggggctcgtgggagaggacgccccagccctgagacttcccgaggttgtttccattcagtgatcagcactagaacacagacgactcacagtggtagttggactggtagttggttactttttccgttttaggtacttaagttttaaaaggtcgtacctagttagtagaacgtgacgttaggttcgggtaggtaagttcgggtagggggtacggtcggtttacgggtacgacggtcccggtggaccgtaccgggttcccgtaggaaccgtaccttcccgtaccgtggttccgaccgtacgtcccgttcggtaggtacttcgtaacggttccgtttagggtagttactttacgtcgtaccgtacgtcggtaccggtaccggttccggggtaccggtacgggtacgggtaccgggtaacgggggacggtaccggtagggtacggtcggtacgtacgtaagtagtacggagtaggtagtacggtcgtaacccttaccggaggtacccgtacgggtacgtaaccgttgggtacgggtaaacggggtaccgggtaacgttaaccctaccgaaccttacgtaccccgtaacgaacggtaacccgaaacccgaaacccggtaacccgtaaaccgtaccccttttacggtacgtttaaccacggttaaaccaaaggttaataacccgggtaaactcggttaaggcggaatccgggtaaacgtacgggaccgttaccccggtacccgtttaccctttaggttcgtttaaccgg

SEQ ID NO: 17880 - DNA, 721 bp, Homo sapiens
  misc_feature: GYAE6OF01DQADN.43.70.G04.1.454.CMB.1.raw
tcagtgtgagtagtcacgaccggtgctcgatttagtgtagtgtgaagggaaagggcacgaccggtgctcgatttagtgtagtgtgaagggaagggggctcgtgggagaggacgccccagccctgagacttcccaggttgtttccattcagtgatcagcactgaacacagaggactcaccagtggagttgggactggagttggtatttttccttttggcttaagttttaaaaggtgtccgtagttgtagaagtgcgtaggttggtaggaagtcggtgggggagtcgttggtacagtccgtggctacggtccctgacgtcctctcgtgtcgcacgcgtcgtggtacttcgtagttcgtttggtagtaatttcgtacgtacctagttcgccgtacggtcggggtccggacggtaacggggtccgaacgggggacggtccgtaggggtacgtgggttcctaagtaaggttacgttaggacggtaagggtacttaggtacgaacgtttaccccggtaggtacccgtaaccgcggtaacgtacggttaggtacgggaacgggacgttaacttaccgacgtaaccgtccgtaccgaaggaacgtaacccgaaccgtacccgaaacgtaaccttaccctacggtacttacgacgtaacaaagttacgaacgtacgttgacgtaggacggtcgtacggacggtaacacccggtcgttacgttactttacg

SEQ ID NO: 17881 - DNA, 788 bp, Homo sapiens
  misc_feature: GYAE6OF01DBO9T.43.70.G04.1.454.CMB.1.raw
  modified_base (700)..(700): a, c, t, g, unknown or other
  misc_feature (700)..(700): n is a, c, g, or t
tcagtgtgagtagtcacgaccggtgctcgatttagtgtagtgtgaagggaaaggcacgaccggtgctcgatttagtgtagtgtggaagggaaaggggctcgtgggagaggacgcccccagccctgagacttcccgaggttcgtttccattcgagtgatcagcactagaacacagagactcaccagtggtagtgggactgtagttggtactttttccgtttggactttagtttaaaaggtgtacctaaggtgtgaagtgacgtaggttggtaggtaagttcggtggggtagccgtttggaccgaggtccgtggaccgtacggtccctggacgttacctccgttccgtggtcacgtacgtccgttacgtacggttacttaccgtaggttccggttttaggagtttaacgttagtccgtaccgtaagtccgtacggttaccggttgggtaccccggacgtaccggggtaccgggaacggggacggtccggtaaggtcgggttacggttaacgtacggttaaaggttaacgttaggaccggtaaggtacgtaacggtcgtaaaccgtaccggtacggtacgtaccggtcgtaacgttcggtaggtaagggacgggtactaccgttaccaacgtcgtaccgtaaccgaagaaccgaaaccgacccgtaaaccgaaccgttacccgtcttacggttacaacgttanaacgtaaacgagaaaccgtcgtacgtacgaaggtaccgtacgaacggtaacccaacccgggccctttaaccgttacgttaacgttacg

SEQ ID NO: 17882 - DNA, 798 bp, Homo sapiens
  misc_feature: GYAE6OF01EJT9E.43.70.G04.1.454.CMB.1.raw
  modified_base (747)..(747): a, c, t, g, unknown or other
  misc_feature (747)..(747): n is a, c, g, or t
tcagtgtgagtagtcacgaccggtgctcgatttagtgtagtgtgaagggaaagggcacgaccggtgctcgatttagtgtagtgtgaagggaaagggggctcgtgggagaggacgccccagccctgagacttcccaggttgtttccattcagtgatcagcactgaacacagacggactcaccagtggtaggttgggactggtaggttgttatttttccgttttggtactttaagttttaaaaggtgttacctagtgtagaagtgtacgtggttggtaggtagtcggtagggggtacgtcgttgtacgacgtccgtggccgtacgtccgtagacgtactccgtccgtggtacgccgacgtccttgtacggtactttccgacgttcgtttaggtagtattagtcgtaccgtataccgtcgtaccgggtcgggtccgggacgtacggggtaccgtaagggggaccggtaccggtgggtacgggttcggtaccgttacgtaaagtttcgtaacggtacggtaagggttaaccgttaagggtaccgttaaacccggttaaacccgggttcggtaaccgggttacccgggaccgggttaacgtttccgggtagggttaaacggggaccgggttaacttaccggtttacccaaccgttaccgttaccgaaccgtaaggaccgtaaaccgaccccaaccgtaacgtaacccttcgttacgagttacacgtaagaacgttaacacggtacttcgganaacgtacgacggacgtaacggacccgtaccttccgttatacggttttaccg

SEQ ID NO: 17883 - DNA, 611 bp, Homo sapiens
  misc_feature: GYAE6OF01CLZZK.43.70.G04.1.454.CMB.1.raw
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagcccccagcccctgagattccccaggtgtttccattcagtgatcagcactgaacacagaggactcaccatggagttggactgagttggtattttccttttggtactattttaaaaggtgtccagtgtgaagtgctagttggtagatcgtgggggtagcttggtacnggcctggcacggtccctgacgtacctctccgtgtcgcacggcctcgtggtacttcgagtctttggtgtattntgtcatgcacgtggtccgcgaggtcgagggacggccgtggtagtggttcacgtaagtagttagcgaagggtataggtacgtaactacccgtaggtccgtaccggcgtacgttacgtggtagggaagggtccgtatccgaccgtctcacgacgaacgaccaacggtaccaagtaacctccttagtactctacgtacaaacgtntaaaccgngtcgtaggaagtacgacgtgtaactacgacccgtaccctccgttctttaacg

SEQ ID NO: 17884 - DNA, 682 bp, Homo sapiens
  misc_feature: GYAE6OF01CHOW4.43.70.G04.1.454.CMB.1.raw
  modified_base (226)..(226): a, c, t, g, unknown or other
  misc_feature (226)..(226): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagcccccagccctgagattcccaggtgtttccattcagtgatcagcactgaacacagaggactcaccatggagttgggactgagttggtattttccgtttggctattttaaaaggngtccagtgtgaagtgcagttggtggaagtcgtaggggggagacgttggtacagccgttggcaggttccctgagtaccttcctcctgtcgcacgccctcgtggacttcgacgtcgtttaggtgtattatcggacctaagttcgaccgtacggttcggggtcccggacgtacgggggtcccaaggggggaacggtcccgtgggacggtggggttacctagtaaaggtagttgacgagggttagtagtacgtactaccggtaggccgtaacggcggtaacgtcgttacggaagggaaggggtccgtacttacgacctaagtccccgtaacgaagaaccgtaaccgaacgaccccgtaacgtaaccgttcccgtaagtacgtctaagtacctaaagtacgaaacgtagttccgaaggtacgagcgtacggacgacgtacccggtccttactttcgttacg

SEQ ID NO: 17885 - DNA, 728 bp, Homo sapiens
  misc_feature: GYAE6OF01A8BPW.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagacttcccaggtgtttccattcagtgatcagcactgaacacagagactcaccatggagttgggactgtaggttggttactttttccgttttggtacttaattttaaaaggtgtcctagttgtagaagtgctaggttgggtagtaagttcggtaggggggtacggtcgtttacggtacacggtcccgtgggcctacggtcccctggacgtacctccttccgtgtcgcgtacgtccctcgtcggtactttacgaggttccgtttggtagttagtttactcggtaccctagttcggaccgtaccggttcggggtcccggtacggtaaccggggtccgggtaagggggaccgggtcggtgggtacggttcggtctaacggtaagttacgtacggacgtaagggtataggtacgtaacgttaccgaggtaccgtaccggcgtacttggtcggtagggtaacgggtcctatcctacgtcttccgacgtagacgaaccgaccgaccgtaactaccttcgtacgtactctaggaactaaacgtacgacgtactaggtagacgtacggtcgaacggacggtaccgacccggtttcccttagttacccgtttcg

SEQ ID NO: 17886 - DNA, 758 bp, Homo sapiens
  misc_feature: GYAE6OF01C2LBR.43.70.G04.1.454.CMB.1.raw
  modified_base (347)..(347): a, c, t, g, unknown or other
  misc_feature (347)..(347): n is a, c, g, or t
tcagtgtgagtagtcacgaccggtgctcgatttagtgtagtgtgaagggaaggggcacgaccggtgctcggatttagtgtagtgtgaagggaagggggctctgggagaggagccccagccctgagattcccaggtgttccattcagtgatcagcactgaacacgagaggactcaccatggagttgggactgagttggtattttccgtttggctaagttttaaaaggtgtccagtgtgaacgtgctagttggtgaatcgtggggagcttggtacagccttggcctaggtcccttgagtactcgtcctagtgactagcctgtgaacttcgagtcgtttggagtattacngtccagtcgacgtcggtacggtcccggagtacggggtaccgtaaagggggacgggtcccgtaggggtaacggtggggttaccctacgggtaaggttaccgtttaggaaccgtagggtataaggttaccggaacgttaaccccgtagggtacccgtacggtaccccggtacgttaacccggtggttacgggaacgggggtccgtaacgttcccgaccgtttaacgtcccgttaaccggaggtaaaccggaaccgtaacccggaaccggtaaacccggtaaccctttaccccggttaggtttacctaccggttcgtaaccgtaaaacgtacggtaaacgtacggtacgttacggaaaggcggttaccgaaggtaccggtaacgaccccgtttacctcgtttaacgtttaccgg

SEQ ID NO: 17887 - DNA, 766 bp, Homo sapiens
  misc_feature: GYAE6OF01BVF75.43.70.G04.1.454.CMB.1.raw
tcagtgtgagtagtcacgaccggtgctcgatttagtgtagtgtgaagggaaagggcacgaccggtgctcgatttagtgtagtgtggaagggaaagggggctcgtgggagaggacgcccccagccctgagtacttcccgaggttgttccattcgagtgatcagcactgaacacgagagactcaccagtggagttggatgagttgtattttcgttgtacttaagtttaaaggcgtcgtagtgtagaagtgacgtaggttaggggaattcggtgggggagtcggttcggtacacggtccgtaggccgtacggtccgtaggacgtaccttccgtccgttagtcgaccgtacgtccgttcgtcggtacttcgtacggttcgttttaggtacgtagtttacgcggtcctagtaccgtcggtacggtccgggtccggtacggtacgggtaccggtaaggggaaccgggttcgtagggtacggttcgggtaactaggtaacgttagtacggacggtaggtacgtaggtacgtaccgtaacggtcggtaccgtacggcgtacgtggtaccggagggtacgtctaagttcccgaactcgttaccgaagtaacggactaaccgtaacccgacgtaaacgtaccccttcgtagtacctacgaaccgaataacggtaaccgtaacgttcgaacgtaagggactaacccgggtcgtaaacggggtaaccggtaacccgcccccgggttttaaccttagtttaacccggtttggaaaccgg

SEQ ID NO: 17888 - DNA, 871 bp, Homo sapiens
  misc_feature: GYAE6OF01DIDVU.43.70.G04.1.454.CMB.1.raw
tcagtgtgagtagtcacgaccggtgctcgatttagtgtagtgtgaagggaaagggcacgaccggtgctcgtatttagtgtagtgtggaagggaaagggggctcgtgggagaggacgccccagccctgagacttcccgaggttcgttcctattcagtgatcagcactagaacacgaaggacggacctaccaaccgtagtagggtaggtttggggacttaggtacggtttagggtttacttttttcccgttttagggtactttaaagttttaaaagggtcgtacccgtaggttaggtaggtaaaggttggacgttaggtttcgggttaggtaacgttccggggtaggggggtacgtacgtttgggaaccgcggtccgtacggaccgtaccggttacccgtaggtacgtaccttccgttccgtgtacgccacgttcctcggttagtacgttcgtaggttcgttggagtttagtactcgactagtcgcgtacggtcggtccggacggtacgggtaccgaaggggcgtcggtaggtagtcggtacacgtacgtacgtaggaacggtagggtaacttaaggtaccgtaaacgttacccgggtaaggacccgttaaacgggtccggtaacgttacgggttgggtaaccggggtaacggggtcctaacgttacccgtaacgtaacctcccgtaacgaaccggtaacaacccggtaaaccgtaacccgtaaacggttaacccttccgttaagtacccggtagtaaacgaaaccgttaaggtaaaccgaacgttcggtaacggtacgggaagttaacgcggaaaaccggttaccggaaaccccgttcccggtttaaccctttacggttttggttaacccgg

SEQ ID NO: 17889 - DNA, 748 bp, Homo sapiens
  misc_feature: GYAE6OF01CTOKD.43.70.G04.1.454.CMB.1.raw
tcagtgtgagtagtcacgaccggtgctcgatttagtgtagtgtgaagggaaagggcacgaccggtgctcgatttagtgtagtgtgaagggaaaggggctctgggagaggagcccccagccctgagattcccaggtgtttccattcagtgatcagcactgaacacagaggactcaccatggagttggactgagttggtattttccttttggacttaagttttaaaaggtgtccagtgtagaagtgcgtaggttggtggtaagtcggtgggggaggtcgttggtacgagtccgtggccaggtccctgagtacctctccgtgtcgcacgtcccttcgtaggtacttccgagttcgttttgggtagtaagtttactcgtcctagtcgacgtaccggtcgggtcccggacgtacggggtaccgaggggaacggtccgtagggaggtcgggtctaacgtaagttacgtaggacggtaagggtacgtaggtacgtaacttaaccccgggtaggtaccgtaacggtaccggtaccgttcggtagggttacgggaaacgggggtctaaccgtttaccaacccgtaattcccgtaacccgaaacggtaacgaaacccgaacccggaacccgtaaaccgtaaccccttcccgtaacgttaacgtacctaagtaaccgtaaaagtacgaaaccgtagtacgtaaggaggtacgtcgtaacggaccggtaccgtaccccggtccttcgttaactttaccgg

SEQ ID NO: 17890 - DNA, 716 bp, Homo sapiens
  misc_feature: GYAE6OF01AJH7J.43.70.G04.1.454.CMB.1.raw
  modified_base (222)..(222): a, c, t, g, unknown or other
  misc_feature (222)..(222): n is a, c, g, or t
  modified_base (272)..(272): a, c, t, g, unknown or other
  misc_feature (272)..(272): n is a, c, g, or t
tcagtgtgagtagtcacgaccggtgctcgatttagtgtagtgtgaagggaagggcacgaccggtgctcgatttagtgtagtgtgaagggaaaggggctctgggagaggagccccagccctgagattcccaggtgtttccattcagtgatcagcactgaacacagaggactcaccatggagttgggactgagttggattttcctttggctattttaaaaggtntccagtgtgaagtgctagttggtaggaattcgtgggggagtcttggtacngccgttggcacggtccctgaagtctcgtcctgtcgccagtccctgtggtactttccgaggttccgtttgggtacgtatttaagcgacctagtacgctacggtcgggttcccggacggtacgggtacccgtaagggggtacgggccgtagggggtaacggttcgggttacctaacgtaaagggttacgttacggcggtaacggggtatacggtcgaaccgttccccgtaggaccgttaaccggtccggtaacttcggtaggtacgggtaaacggggtcgttaacctacgtacccgtgtaccgtcccgaagtaccggaactaaccggactaacggacccttactggttactacgtacgactaaacggttgaacctaacggttcccaggtaacggtacgaccggttaccggaggaaccccgtacgtaccctttacggtcgtttacgg

SEQ ID NO: 17891 - DNA, 765 bp, Homo sapiens
  misc_feature: GYAE6OF01DL8KA.43.70.G04.1.454.CMB.1.raw
tcagtgtgagtagtcacgaccggtgctcgatttagtgtagtgtgaagggaaagggcacgaccggtgctcgatttagtgtagtgtgaagggaaaggggctctgggagaggagccccagccctgagacttcccaggttcgtttccattcagtgatcagcactgaacacagacgactcaccagtggtagtggctgtagttgttatttttccgtttgtacttaagtttaaaggtcgtacctaggttgtagtaaggtgacgtaggtttcggtaggtaacgttcggtggggggtagtcgtttcggtaacgaggtccggtggaccgtacgggtcccgtaggtacgtaccttccgtccgtgtacgtccgtacggtcccttcggttacggtactttccgagtttcggtttagggttacgttaagtttacgtcgtactacgtacggccgttaaacgggtcgggtacccgggtacggtaaccggggtaccgggaacggggtaacgggtccggtagggtagggttacggtacgtagtaacggttagtaggtacggtaagggtatacggtacgtaacgtaccgtaggtaccgtacggtacgtactcggtaggtgggaacggtacgtacgtacctacctacgtaccgacgaacgaacgaacccgaccgtaccgtaactaccgttacgttacgtactacgacgtaactaacgtactaacgtacgtacgacgaggtacgtagtacgggaaccgtacgtacccgtactttacgttgttaccg

SEQ ID NO: 17892 - DNA, 215 bp, Homo sapiens
  misc_feature: GYAE6OF02G9QNH.43.70.G04.1.454.CMB.1.raw
  modified_base (192)..(215): a, c, t, g, unknown or other
  misc_feature (192)..(215): n is a, c, g, or t
tcagtgtgagtagtcacgaccggtgctcgatttagtgtagtgtgaagggaagggcaggtatcaccgcgttccggcacggattctgacttagaggcgttcagccattatccggcagatggtagcgtcgcggcactgcctggtcaaggactacgttccactactcaactgagcgggctggcaaggcgcgatagnnnnnnnnnnnnnnnnnnnnnnnn

SEQ ID NO: 17893 - DNA, 190 bp, Homo sapiens
  misc_feature: GYAE6OF02FI9EQ.43.70.G04.1.454.CMB.1.raw
  modified_base (190)..(190): a, c, t, g, unknown or other
  misc_feature (190)..(190): n is a, c, g, or t
tcagtgtgagtagtcacgaccggtgctcgatttagtgtagtgtgaagggaagggcagtatcaccgcgttccggcacggattctgacttagaggcgttcagccattatccggcagatggtagcgtcgcggcactgcctggtcaaggactacttccactactcacactgagcgggctggcaaggcgcatagn

SEQ ID NO: 17894 - DNA, 562 bp, Homo sapiens
  misc_feature: GYAE6OF02IC1CB.43.70.G04.1.454.CMB.1.raw
  modified_base (394)..(394): a, c, t, g, unknown or other
  misc_feature (394)..(394): n is a, c, g, or t
  modified_base (466)..(466): a, c, t, g, unknown or other
  misc_feature (466)..(466): n is a, c, g, or t
  modified_base (528)..(528): a, c, t, g, unknown or other
  misc_feature (528)..(528): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggatttttcctttggcttattttaaaaggtgtccagtgtgaagtgcagttggtggaatcgtgggggagcttggtacagcctggcaggtccctgagactctcctgtgcagcctctggatttcagtctttgggtgatttatgccatgcacgtgggtccggcaggggtccaggggaacggcctggagtgggtctacgaagtnttagcgagggatagtgatacccgtaggctacggcggtactcgtgtaggaaggggctattcacatccacaganacaacgccaaagacctccctagtacttccgagactaaagtcgaactagtacgtagaaggacncgtacggaggaccaccggtcccttcttatttccg

SEQ ID NO: 17895 - DNA, 587 bp, Homo sapiens
  misc_feature: GYAE6OF02IU3ZI.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttccttttggcttattttaaaaggtgtccagtgtgaagtgcagttggtggaatcgtgggggagcttggtacagcctggcaggtccctgagactctcctgtgcagcctctgggattcgagtcttttgggtgtattatgccattgcacgtgggtccgcgaggggtccaggggaaggcctggagtgggtctcgaagtatagcgagggataggtgataccgtaggctacgcggactcgtcgtggaaggggcgagttcacctactcctccgagacgaacaacggaccaaacggaacctcccgttagtacttactacgacctaaatacggaaacagttaccgtgaaggacgtcgtaggaacgggacaccgggtacccctacgttactttaccg

SEQ ID NO: 17896 - DNA, 785 bp, Homo sapiens
  misc_feature: GYAE6OF02JH5EI.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggctattttaaaaggtgtccagtgtgaagtgcagttggtggaatcgtgggggagtcttggtacagcctggcaggtcctgagactctcctgtgcaggtcctcgtggatttccgagtccgttttgggacgtatttagtcgccctagttggacctaaccggttggggttccccggacgtaacggggggttccccgaagggggtaaacgggggtccctagggggtaggtcgggggttctaccgtaaaagggttacgtttacggaccgtaagggggtacgttaaggtacgtaaccgtttaacccgtacgggaccgttaaccgggccggtaaacgttccggtaggtacgggtaaacgggggttcgtaacgtttaccggaccgtaacgttacccgtacccgaaggtaaccggaaacccgtaaccggaacccgttaaacggaacccgtttcccgtaacggttaccttaaccgtacgtaaccgtaaacgttacgggaaccctaaggtaaccgttggaaacggtaccgtacgtaacgggtaaccggtacccgtaaccgggtcccctttaacgttacgttttaacccgg

SEQ ID NO: 17897 - DNA, 757 bp, Homo sapiens
  misc_feature: GYAE6OF02IDU9I.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagcccccagccctgagattcccaggtgtttccattcagtgatcagcactgaacacagaggactcaccatggagttgggactgagttggtattttccgttttggcttaattttaaaaggtgtcctagtgtgaagtgctagttggtaggaatcgtgggggagtcgttggtacagccgttggctaaggtcccctggacgtacctctccttgtcgcacgtcctcgtggtattccgagttcgttttggtatatttagtcggacctagttcgaccgtacggttcggggtcccggacgtacgggggtacccgaaagggggtaacgggtcccgtaggggtacggtcggggttactacggtaaaggtttaacgttaggacggtaaggggtacttaagggtacgtaacgttaaccccgtaggtccgtaaccggtcgggtaacttccggttagggtaacgggtaacggggcttaacgttccgaaacccgtacgttcccgaaccgtaaggaacgaaccgtaacccggaccctaaaacggtacccttacccgtagtaaccgtccgaacgtactaaacgtcgaacgtaacgttacgtcggaacgtaacgcgttaacggaaccggtaacccgtacccgggtacctttacgttagtttaccgg

SEQ ID NO: 17898 - DNA, 817 bp, Homo sapiens
  misc_feature: GYAE6OF02I3ILQ.43.70.G04.1.454.CMB.1.raw
  modified_base (305)..(305): a, c, t, g, unknown or other
  misc_feature (305)..(305): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggctattttaaaaggtgtccagtgtgagtgcagttggtggaatcgtgggggagcttggtacagcctggcaggtccctgacgctctcctgtgcagcctntgggattccgagtccgttttgggtgtatttagtgtcccattcgcctacgttcgggggtcccggacgtaacgggggttcccgaaggggggtaaccgggtcccggttaggggaagggttcgggggttacctacgtaaaagggtttaacgtttacgggaccgtaaaggggggtacttaagggttacggtaaacgttaacccccgttaaggggtaccgttaacccgggaccggggtaacccttaccggttagggtaacgggaaacggggggttccgtaacgtttacccgaacccgtaacgttacccgtacccgtaaggaaaccggaaacccgaaacccggaacccgaaaaccggtaaacccgtttaccccgtaacgttaaaccttaccgttaacggtaacctaaacgttacggtaaacctaacggttaccgttagggaacgtacgggtaccggtacgggtaaccgggaaacccgtacccggggtacccccgttttaccttaacggtttttacccgg

SEQ ID NO: 17899 - DNA, 723 bp, Homo sapiens
  misc_feature: GYAE6OF02JBYXI.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggatttttcctttggcttattttaaaaggtgtccagtgtgaagtgctagttggtggaatcgtgggggagcttggtacagcctggcaggtccctgagactctcctgtgcagcctctggattcgagtcgtttggtgtatttatcgccagtcggcctaccgttggggacccggtccgtaagggggttccccgaaaggggggtaacggggtcccgtaggggacggttcgggggttaccttacggaaacgggttatttacggccgtaaagggggtattaagggttacgtaacgttaaccccgtaagggtaccttaccgggaccggtaccgttccgtagggtcggtaaagggggtccgtaagtttccgaacccgtagttccctaccgaaacggagtaacccgaaaccgccaaaacgtaacccgttacccgttagtaaccgttcctcggaactaaacgtacgtaacgtacggttacgaggtaacggacgtacgtacggacggtaaccgtacccggccctttacgttatttaccgg

SEQ ID NO: 17900 - DNA, 630 bp, Homo sapiens
  misc_feature: GYAE6OF02GM1IA.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggtatttttccttttggtcttattttaaaaggtgtaccagtgtgaagtgcagttggtgaatcgtgggggagtcttggtacagcctggcaggtccctgagactctcctgtgcagcctcgtggtattcagtctttggtgtattagtgccatgctacgtgggtccggcgacgggtccgaagggggaacgggccgtgggaggtcggggtactacgaaagttattaggcgaagggataggtcgtatacccgtaggctacggcgtacgtcgtggtacggaagggtacgtattaccgaccgtactcctaccgaagacgaaccgtaaccgacccgaaacggtaaccttacccgtacgttactacgtcgaactaacgtcgtaacgtagtacgtaggaagtacgtagtacggacggtaaccgacccgtcccttacttacgttccg

SEQ ID NO: 17901 - DNA, 692 bp, Homo sapiens
  misc_feature: GYAE6OF02F5TDZ.43.70.G04.1.454.CMB.1.raw
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttccttttggcttattttaaaaggtgtccagtgtgaagtgcagttggtggaatctgggggagcgttggtacagcctggcaggtccctgagactctcctgtgcagcctcgtggattcgagcttttgggngtattagtgccatcgcacgtgggtccgnaggggtccagggaggctgggagtgggtctcgaagttattagacaaggatagtagactaccgtaggctacgccgggtaactcgtacggtaggaacgggggtacgtacgtttaccaacccgtattcccgtacccgaaggaaccgtaaacccgaaacccggtaacccgtaaaacggtaacccttacccccgttagttaccgttacctacggtaacctaaaacgttcggaaaaccgttacgggttacctttagggaacgggtaacggtccgttaacggggaaccgggtaaaccccgtaacccgggggttacccccctttacgtttacggtttttacccgg

SEQ ID NO: 17902 - DNA, 733 bp, Homo sapiens
  misc_feature: GYAE6OF02GG9DE.43.70.G04.1.454.CMB.1.raw
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcacgtgaacacagaggactcaccatggagttgggactgagttgggattttccttttggctattttaaaaggtgtccagtgtgaagtgcagttggtgaatctggggagcttggtacagcctggcagtcctgagactctcctgtgcacgcctctggtacttcagtctttggtnactttatgcctatgcacgttcgggtccggngacggggtaccaggggaacgggtcctaggggaggttcggggtactaccggaaagttagttaacggcgtaaggggtaacttaggttagtaacgttaaccccgtaacggtaccgtaaccggccgggtaccgttacggtcggttacggaaagggggtcgtaacgtttaccaaccgtaacgttccttacccgaagtaccggaaaccaaacccggtaaccctaaacggtaacccgttaccccgttacggtttaaccgtaccgttacggaaccctaaacgtttcggaaaacccgttacggttaacgttaacggaacgtaacggtcccgttaacgggacgggttaacccgacccgggtacccctttaccgttacgttttacccgg

SEQ ID NO: 17903 - DNA, 652 bp, Homo sapiens
  misc_feature: GYAE6OF02GXL2G.43.70.G04.1.454.CMB.1.raw
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttatttaaaaggtgtccagtgtgaagtgcagttggtggaatcgtgggggagcttggtacagcctggcaggtccctggacgactctcctgtgctagcctctggattcgagtcttggntattntgcatcgctacgtcgggtccgcgagggtccaaggggacggtcctagggtacggtgggtctacgtaaagtacgttagcgtaagggtataggtatacgtaacccgtagggtactacggtcggtaccttcgtaggtagggaacgggggtccgtaactttccgaaccgtactccgtacccgaaggtaccgaaccgaaccgaccgtaaacgtaacccgttcccgtacgtacttacgtacgaacctaagtaccgaacgtacgtaccgtaggaacgtacgtacgtacggacgaacccggtaccgtacccgttacgtaacgtttaccgg

SEQ ID NO: 17904 - DNA, 716 bp, Homo sapiens
  misc_feature: GYAE6OF02JMGMW.43.70.G04.1.454.CMB.1.raw
  modified_base (311)..(311): a, c, t, g, unknown or other
  misc_feature (311)..(311): n is a, c, g, or t
  modified_base (497)..(497): a, c, t, g, unknown or other
  misc_feature (497)..(497): n is a, c, g, or t
  modified_base (576)..(576): a, c, t, g, unknown or other
  misc_feature (576)..(576): n is a, c, g, or t
tcagtgtgagtagtcacgaccggtgctcgatttagtgtagtgtgaagggaaggggcgacgaccggtgctcgagtttagtcgtagtcgtggaagggtaagggggcttcgttgggagtagggagccccagccctgagacttcccaggtgtttccattcagtgattcgagtcactggaactacgagaggactcacctatggagttggactgagttggattttcgtttgcttagtttaaaaggtgtccaggtgtgaagtgctaggttggtgaattcgtgggggtagtcgttggtacacggctggtcaggttcccnggtacgtacttcgttccgtgttcggcacgtccgtcgttgggtacttcgtcgttcgttttcggtgtacgtttaagtccggactgtgactacggtgggttccggacgacggggttaccgaaggggtaaccggtcggtaaggacggttcggtacgttacgaaaggtttaacgtggactaagggggggtntacggtaagtaccttaccgtaaggtccgtacgtaccggtatccgtggttaacggacgggtagtacgttacgaccgtacncgtaccgaagtacgtaccaccggtacacgaacccttcgtacgttacacccgtagaccgtaacgtacggtaacgtacgttaggaacgtacggacgttaacgacggacggtaccggtaccggtacctttacgttcgttacgg

SEQ ID NO: 17905 - DNA, 733 bp, Homo sapiens
  misc_feature: GYAE6OF02GXJG8.43.70.G04.1.454.CMB.1.raw
  modified_base (334)..(334): a, c, t, g, unknown or other
  misc_feature (334)..(334): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttagttttaaaaggtgtccagtgtgaagtgctagttggtggaatcggtgggggagtcgttggtacagcctggcaggtcccctgagactctcctgtgcagcctcgtggattcgagtcgttttggngtattatcgcctagtcgactaccgtggggtcccggacgacggggttaccggaagggggtaacggggcccgttaggggacggttcggggttacctaacgtaaagttaggttacggacgtagggtataggtagtacgttaccccgtaggtaccgtacggcggaccgttgtacggtagggtaacggggtctaacggttccaacctacgttcccgtaccaacggaccgtaaaccgaacccggacctaaaacggtaaccctttacccgttagttaaccgtacgttaccggtaacaacgttaaccggaacgtaccgttacctaagggtaacggaaccgtaacggtagggtaaccgggtaccccgtaacccgggttaccccgtttaccgtttaacgtttacccggg

SEQ ID NO: 17906 - DNA, 620 bp, Homo sapiens
  misc_feature: GYAE6OF02GAVXK.43.70.G04.1.454.CMB.1.raw
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttatttaaaaggtgtccagtgtgaagtgctagttggtggaatcgtgggggagcttggtacagcctggcaggtccctgacgactctcctgtgcagcctctggattcagtctttggngtattangcctatcgacacgtcgggtccgcgtacggggtccaaggggacggtccgtgggacgtgggtactcgaaaggttattaggcgtaagggtactaggtagactaacccgtaggtcgtacggacggtacgtcgtaggtaggaacggggctagttcgacctagtacctaccgagaacgaaccaaccgaccgtaaacgtaacctcccgtacgtactctacgaactaagtacgaacgtcggtactaggaacgtacgacgtaggacggaaccgtaccggacccttagttacgtttcg

SEQ ID NO: 17907 - DNA, 853 bp, Homo sapiens
  misc_feature: GYAE6OF02GWXKS.43.70.G04.1.454.CMB.1.raw
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
tcagtgtgagtagtcacgaccggtgctcgatttagtgtagtgtgaagggaaagggcacgaccggtgctcgatttagtgtagtgtgaagggaaaggggctctgggagaggagccccagccctgagattcccaggtgtttccattcagtgatcagcactgaacacagaggactcaccatggagttgggactgagttggatttttcctttggcttaatttaaaaggtgtccagtgtgaagtgcaggttggtggaatcgtgggggagtcttggtacagcctaggcacggtcccctaggactacctcttcctggtcgcacgccttcgtggatttccgagtcgttttgggngtaatttacgngtccctatgactacggttcggggtcccggcgtacgggggtaccgaagggggtaaccggtccgttagggtacggttcgggtcttacgtaaaggtttacgttaggccgtaaagggggtagttaacggtacgtaaacccgtttacccggtaaacggggtcccgttaacgggtacccgggtaaacccgttggtacggggttacgggtaaaacggggtccgttaacgtttaccgaacccggttaacgttaccccgtaaccggtaaggaaacccgggtaaccaaaccccggtaaacccgtaaaacggttaaaccccctttcccgggtttaagttaaacccgtttacccggtaaccgggtaaaccttaaaacgtaccgggtaaaaccgttaacgggttacccggttaaagggtaaaccgggtaacgaacccgggtttaacgggaaacccgggtaacccggttacccccgggtaaccccttttacggttaccgttttttcccggg

SEQ ID NO: 17908 - DNA, 774 bp, Homo sapiens
  misc_feature: GYAE6OF02F7OBO.43.70.G04.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggctattttaaaaggngtcagtgtgaagtgcagttggnggaatcgtgggggagcgttggtacagcctggcaggtccctgacgactctcctgtgcagcctntggattcagtctttggngtattatgcctatcgactacgtgggccggacgacggggtccagggggaacggtccgtagggaggttgggtcctacgaaagttaggttagacggtaagggtacgtaggtacggtacgttaacccggtacggtacgttaaccggaccgggtaaccttcggtacgggtacggggtaaacggggggttcggtaacgtttacccggaacccgttaacgtcccgttaacccggaacggtaaccggaaacccgtaaacccgggtacccgaaaaacggttaacccccttaccccggttaagtttaacccgttaccggttaccgaaaccgttaaaccgtacggaaaacccgttaacggttacccggttaacggtaacgggtacggttacccggttaggggaacccgggtaaccggtaaccccgggttaccccgtttacgtttaacccgttttaaccggg

SEQ ID NO: 17909 - DNA, 754 bp, Homo sapiens
  misc_feature: GYAE6OF02IK2U3.43.70.G04.1.454.CMB.1.raw
  modified_base (248)..(248): a, c, t, g, unknown or other
  misc_feature (248)..(248): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggatttttcctttggcttattttaaaaggtgtccagtgtgaagtgcagttggnggaatcgtgggggagcgttggtacagcctaggcaggtccctgacgactctcgtgtcgcacgtcctcgtaggtatttccgaggtccgtttgggtatagtttacgtcgaccctagtcgaccgtacggttcggggtaccggcggacggggtccgaaagggggacggtccgttagggacgggttcgggtactacggtaaaggttacttacgggacgtagggtacttaggtacgtaaccgttacccgtacggtaccgttaccgggtacggtaccttcggtagggtacgggtaacggggtaccttaacgttaccgtaaccgtacgttacccaccggtaacggaaccggtaaaccgtaacccggaccgtaaacggtaacccgttaccccgtaagggttacctaccggttacgtaacctaacggttacgaaaccgtacgttaccggtgtaacggtaacggtcgttaacgggaccggttaacccacccgggtacccctttagttaccgtttacgg

SEQ ID NO: 17910 - DNA, 865 bp, Homo sapiens
  misc_feature: GYAE6OF02IRW8V.43.70.G04.1.454.CMB.1.raw
  modified_base (218)..(218): a, c, t, g, unknown or other
  misc_feature (218)..(218): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgttccattcagtgatcagcactgaacacagaggactcaccatggagttgggactgagttggatttctttggctatttaaaggntaccagtgtgagtgacagttggtaggaatcgtagggggagtcgttggtacaggtccgtggactacggtccctggacgtactcgtacctggttagccaacgtcccttgtacgggtaacttttccggaaggttccgttttagggtagtaagtttacttccggaccctaagttcggaccgttacggttacgggggtaccggtacgtaacggggggtacccgtaaggggggtaaccggggtccgttaacggggtacgggttcgggggttacctacggtaaacggttacgtttacggacgggtaaggggtaacttaacgggtacgtaaacgttaccccggtaagggtaccgttaaccggtaccgggtaaccgttaccggtagggttacggggtaaacggggggtacccgttaacgtttaacccggaaaccgttaccgttaccgtacccggtaaaggtaaacccggaaccgtaaacccggaaccgtaaaccggtaacccttacccgttagttaaaccgttcccgtaacgtaacctaaacgttaaccggtaacccgtaacggttccgtaacggtaacggtaacgtaccggttacggaaaccgggttaaccccgaacccggggtaccccctttacgtttaaccgtttaacccggg

SEQ ID NO: 17911 - DNA, 603 bp, Homo sapiens
  misc_feature: GYAE6OF02IU810.43.70.G04.1.454.CMB.1.raw
  modified_base (557)..(557): a, c, t, g, unknown or other
  misc_feature (557)..(557): n is a, c, g, or t
  modified_base (570)..(570): a, c, t, g, unknown or other
  misc_feature (570)..(570): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttatttaaaaggtgtccagtgtgagtgcagttggtggaatcgtggggagcttggtacagcctggcaggtccctgagactctcctgtgcagcctcgtggtacttcgagtctttggtgtattagtcgcctatgctacgtgggtccgcgacgggtccgaaggggaacggccgtaggacggtcgggtactacgtaagttagtacggacgtagggtataggtgaactacccgtaggccgtacgcggtactcgtaggtaggaacggggtctagttccaccgtatccctacgaacgtacgaaccgaacgaccgaaacgtaaccttcccgtagtactcgtagaccaatacgaacngtctaggatacgntacgaacggaccacggtcccttacttacgttcg

SEQ ID NO: 17912 - DNA, 837 bp, Homo sapiens
  misc_feature: GYAE6OF02GLRS2.43.70.G04.1.454.CMB.1.raw
  modified_base (227)..(227): a, c, t, g, unknown or other
  misc_feature (227)..(227): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtcgtttccattcagtgatcagcactgaacacagaggactcaccatggagttgggactgagttggattttccgtttggcttaattttaaaggtntcctagtgtagaagtgactagttggtaggaattcggtgggggagtcttagggtactagcccgtaggcgtaggtcccctggaacgtacctccgttccgtagtgtaccacggtccctacgtgggaacttcgtaacgtcgttttggtacggttaacttttacgtacgacccgttagttacggtaccccgttaacggttccggggttacccggggacggtaaccggggtttacccggaaagggggggttacccgggtacccggtttaaggggtacggtttacggggggtttacctaaacggttaaacggggtttaaccgtttaacggaaccggggtaagggttaacggttaacggttacggtaacgttaaaccccgggttaacggtacggttaaccgtacccggtaacggttacccgttaggggtacggtaaacgggggtacgttaacgtttaccgaccgtaaccgttcacccggtacgaacgtaaccgaccgtaaccgaacgtacccgtacctacgtacgtacgtactaacgtaagtacgtaacgtacggtacgttaggacgtaaggtccgtaggtaacggaaccgtcccggtacctttcgtacgtttaccgg

SEQ ID NO: 17913 - DNA, 747 bp, Homo sapiens
  misc_feature: GYAE6OF02FY77T.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccagtggagttgggactgagttggtatttttccgttttggcttaagttttaaaaggtgttccagtgtgaagtgctaggttggtggaattcgtgggggtaggccgtttaggtacgagccgtggccgtacggtcccctggacgacttccgtcctggtcgccacggtcccttcgtgggtactttcgacggttcgttttgggtgtaatttacgtgaccctagtcgtaccgtaccggttcggggtcccggtcggaacggggtccgaaggggtacggggtcccgtagggtacggttcgggtaccgttaacgtaaggttagttacggacggtaaggggtagttacggtacggtacgttaccccggtaggtaccgtaccgggtcgggtaccgttcggtacgggtagggtaaccggggtacgtacgttacccgtacctagttccgtaccgaacggtacgaaccgaaccgaccgaaacgtaaccttcccgtaacgtactacgtacgaacctaagtacgtaacgtcggtaactaggagtaccgtcggtacgccggtaaccgtccggtacccttagtttacttcg

SEQ ID NO: 17914 - DNA, 799 bp, Homo sapiens
  misc_feature: GYAE6OF02FOO68.43.70.G04.1.454.CMB.1.raw
  modified_base (338)..(338): a, c, t, g, unknown or other
  misc_feature (338)..(338): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggctatttaaaaggtgtccagtgtgaagtgcagttggtggaatcgtgggggaggtcgttggtacagcctggcaggtccctgacgactctcctgtcgcagcctcgtggattcaggtctttggtagtatttangccatcgacctacgtcggggtcccggacgacggggtccgaaggggaacggggtccgtaggggtacggtcggggtactacgtaaaggttacgttacggacggtaaggggtaacgttaggtacggtaaaccgttaaccccggtaagggttacccgtaaaccgggtccggggtaaccgttaccggtttacgggttaacggggaaaccgggggggttaccgtaacgtttacccggaacccgttaacgttacccgttaacccggaaggaaccggtaaacccggtaaacccggaaccccgtaaaacggtaaaccccgtttaccccgttaaggttaccgttaccgtaacgaacctaaacgttaccggaaaccgttaacggttacggtaacggaaacggttacggacgttaacggggaaccgggtaccccggtaaccgggtacccctttacggtttacgttttaccggg

SEQ ID NO: 17915 - DNA, 895 bp, Homo sapiens
  misc_feature: GYAE6OF02J1G3Z.43.70.G04.1.454.CMB.1.raw
tcagtgtgagtagtcacgaccggtgctcgatttagtgtagtgtgaagggaaagggcacgaccggtcgctcgatttagtgtagtgtgtaacgggaaggggtctcgtgggagaggacgccccagcccctgagattccccaggtcgtttaccagttacgtaggtgataccgtagtcctacgttgaacctaacgtaggaacggtaccttccgaaccgtagttagggtaggttcgggaaccttaggtaggtttgggtactttttccggtttagggacctttaaggttttaaaacggtcgttacccgtaggttagtaggtaacgttggacgttaaggtttccgggttaggtaagttccggttgggggaccgttcgtttacggtacgttacggtccccgttgggtaccgtaccgggtttacccgtaggtaaccggttaccgttaccgttccccggttggttaccggtacccggtaacccggtcccgtttacccggttaacgggttaccgttaccggttaacggtttccggtttttagggtacgttaacggttttaccgtacggttaacccggtgtttaccggtacccgttaaggggttccggggttaccggacggtacgggttacccggtaaggggtacggttaccggtagggttacgtacgggtcgtaaccggtaggttacgtacggaccgtaggttacgcggttacgtacggttaaccgtaggtactaccggcgtacctggtacgtacggaggtactacgttcgaacctgtccgtagacgtagaccgacgtacccgaagtaaccgttcgttactacgtacgtacgtaagtacgaggtaacgtcgtacgtagaacgttcgactaggtaaccgtaccgtccgtaaccgtttagtcgtaccgg

SEQ ID NO: 17916 - DNA, 675 bp, Homo sapiens
  misc_feature: GYAE6OF02F5XGV.43.70.G04.1.454.CMB.1.raw
  modified_base (414)..(414): a, c, t, g, unknown or other
  misc_feature (414)..(414): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggattttcctttggcttattttaaaaggtgtccagtgtgaagtgcagttggtggaatcgtgggggaggcttggtacagcctggcaggtccctgagactctctgtgcagcctcgtggtattcgagtcttttggtgtatttagtgcctagtgctacggtcgggtccggcgacgggtccgaaggggacggccgttaggggagttcgggtctacgaaaggttnttaacggctaaggggattaggtacgtacgtaaccccgtagggtccgtaacggccggtacgtcgttagggaggaaggggccgtattccgacctatccctaccgaagtacgaaccgtaccgaccgaaacgtacccgttcccgttagttacgttcacgtaaccgtaaattcggtaaaaccgttggtaccttacggggaaagtaccggtacgtaagggtaaccgggtaacctaccccggggtccccttacggttaactttcccgg

SEQ ID NO: 17917 - DNA, 712 bp, Homo sapiens
  misc_feature: GYAE6OF02JFJ16.43.70.G04.1.454.CMB.1.raw
  modified_base (342)..(342): a, c, t, g, unknown or other
  misc_feature (342)..(342): n is a, c, g, or t
tcagtgtgagtagtcacgaccggtgctcgatttagtgtagtgtgaagggaaagggcgacgaccggtgctcgatttagtgtagtgtgaagggaaaggggctctgggagaggagccccagccctgagattcccaggtgtttccattcagtgatcagcactgaacacagaggactcaccatggagttgggactgagttggattttcctttggctattttaaaggtcgtccagtgtgaagtgcagttggtggaatcgtgggggaggcttggtacagcctaggcaggtccctgacgactctaccgtgtgccagccttcgtaggtacttccgaagtcgtttttacggngtacgttttaactggaccctaagtcgtctacggttgggtcccggacgtaacggggtccgaagggggtaacgggtccgtagggtacgggtcggtactaccggaaaggttacttaggacgagggtagtaacggtagtacgtacccgtaaggcttacggaccggacttcgtcgtagggtaacggggtcttacgttccgaccgattcccaccgtaacgacgtaaccgaaacgcccgaaacggtaaccctcccgttaagtacgttcgtacgaacctaacgtacggtaaacgtaccgttacgtacgggtaaggtaccgtacggttacggacggtacccgtaacccggggtacccctttacggtttaactttcccgg

SEQ ID NO: 17918 - DNA, 678 bp, Homo sapiens
  misc_feature: GYAE6OF02IA7DB.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttggactgagttgattttcctttggctatttaaaggtgtccagtgtagaagtgcaggttggtggaatcggtgggggagcgttggacagcctggcaggtccctgagctcgtctgtagcagtcctctggactttcgaggtcgttttggagtatttatcgaccatcgacctacggtcggggtccgacgtacggggtaccgaaggggacggtccgtagggtacggtcgggtctacggtaagttacgttaacggacgtaacgggtagtagtacgtaaccgtaacccgtagggtaccgttaccggcggtacgttcgtaggtagggaacggggtctacgttaccaaccgtatccgtaaccgaagacgaaccgaacgaccgtaaacgtacccttacccttagtacgtacgtaacgtacgtaacgtacggaacgtacggttccgaaggtaacgtacggtaacgtacggaacggtaccgacccggtaccctttacgtactttacgg

SEQ ID NO: 17919 - DNA, 733 bp, Homo sapiens
  misc_feature: GYAE6OF02G5G5W.43.70.G04.1.454.CMB.1.raw
tcagtgtgagtagtcacgaccggtgctcgatttagtgtagtgtgaaggaaagggcacgaccggtgctcgatttagtgtagtgtgaagggaaagggctcgtggagaggagccccagccctgagacttcccgaggtgtttccagttcagtgatcagcactgaacacagagactcaccagtggagttggactgagttggtatttttccgtttggtacttaagttttaaaaggtgttccgtagttgtagtaagtgcgtaggttggtaggtaactcggtgggggagtcgtttggtaccgagccgttggaccgtacggttccccgtaggaccgtaccttccgttcccgtggttcgaccgtaccgtccgttcgttcggactttcgacgtttcgttttggtagttacgtttacgtcgtcccgtagtcgacgtacggttcggggtcccgcggtacggggtacccgaaggggtaacggtccgtagggacggttcgggtactaacggtaaggttagttacggacgaaggtacgtagtacgtacgtaccggtagtccgtacggtcgtacgttcggtggtacggaacggtacgtacttaccgaccgtacgtccgacgagaccgtaacgaccgtaacgtaaccgtaaccttccgtaacgttcgtaacgtacgaacgtagtacgtaacgtcgtacgtagacgtacgacgtacggaccggtaccgacccggttcccttagttcgttacg

SEQ ID NO: 17920 - DNA, 726 bp, Homo sapiens
  misc_feature: GYAE6OF02HQM2X.43.70.G04.1.454.CMB.1.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
tcagtgtgagtagtcacgaccggtgctcgatttagtgtagtgtgaagggaaagggcacgaccggtgctcgatttagtgtagtgtgaagggaaagggggctctgggagaggagccccagcccctgagacttcccaggtgtttccattcagtgatcgagcacgtagaacacaggaggacctccacctagtggtaggttggactgtaggttggttactttttccgtttggactttaagttttaaaaggtgtacctagtgtacgagtgcgtagttgggtaggtaacgtcggtgggggcggtcgttaggtacngccgtggcgtacggtccgngacctactcgtcgtgtcgacgtcgtcccttggtggttacttcgtacggttcgtttggtagttactacgtcgactagtcgtaccgtacgggttccggccggacggtaccgggaccgggtagggacggtcggtgggtaggtcgttacgtagttagacgtaggaggtaggtagtagtacgtaaccgtacggtagtacggtacgtacgtacgtcggtaggacgggtaacggtacgtactactaccgtacgtaccgacgaagaaccgaaccgaaccgtaccgaacgaccgttccgttaacgtaccgacgtacgaacttaacgtacgtaaacgtcgtacggttacgtaacgtacgtaaggtaccggtaaccggtaccgttaccggtacctttacggttactaacg

SEQ ID NO: 17921 - DNA, 867 bp, Homo sapiens
  misc_feature: GYAE6OF02GNBWI.43.70.G04.1.454.CMB.1.raw
tcagtgtgagtagtcacgaccggtgctcgatttagtgtagtgtgaagggaaagggcacgaccggtgctcgatttagtgtagtgtgaagggaaagggggctctgggagaggagccccagccctgagattcccaggtgtttccattcagtgatcagcactgaacacagaggactcaccatggagttgggactgagttggtatttttccgtttggcttaattttaaaaggtgtaccgtagttgtaggtaagtgtactaggttgggtaggtaagttcggtaggggggaggtcgttagggtacgtacggtccgtaggccgtacgggttcccctggaacggtaccttaccctaccgttgttcggccaacgtcccgtttgtggtactttcgtacgttcgttttgggtagttaactttagacgtacctagtcgtcgtaccggtcgggtaccggcggtaccggggtaccgaagggggtaacgggtccggtaagggtacgggttcggtaccgttagtaaaacggttacgttacgggaacggtaaggggtacttacgggtagtaacccgttaacccggtaccgggtaaccgttacccgggtaacccgggtaacgttaccgggttcggggtaacggggtaaacgggggttaaccttaaccggttaaccccgtaaaccttacgttaacccggtaacccgtaaggaaacccgtaacccgaaaccggtaacccgtaaacgttaaccccgttcccgtaacggttacttacgtaacgaacctaacgttacggtaaccgtaaggttacgtacggtaagtaacccggtggttaacgggaccgtaacccggttacccggtacccctttacgtttaacggttacccgg

SEQ ID NO: 17922 - DNA, 558 bp, Homo sapiens
  misc_feature: GYAE6OF02FS0JW.41.17.B06.1.454.CMB.1.raw
  modified_base (454)..(454): a, c, t, g, unknown or other
  misc_feature (454)..(454): n is a, c, g, or t
tcagtctatactatcacgaccggtgctcgatttagtcgatagtgaagggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcattggaaccagcagtgacattggtggttataactatgtctcctggtatcaacaacatccaggcaaagcccccaaactcatacttttgagtccagtgagcggccgtcaggttgtttctatcgcttctctggctcaagtctgccacgacggcctccctgtcgatctcgtggcctccggcctggaggacgagtctggactattcgcgcgctctattacacttctgagtacgttgggtgttcgggnggtacggtctcgtaccgtcgtacccgttccgtaggtcacggcccgaaggtcctccggtcccccgttcggttaccctacgttcccgttccgttcccccgtccccg

SEQ ID NO: 17923 - DNA, 641 bp, Homo sapiens
  misc_feature: GYAE6OF02GLIO9.41.17.B06.1.454.CMB.1.raw
tcagtctatactatcacgaccggtgctcgatttagtcgatagtgaagggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctctgcactggactcagcagtgagctacaacttctaatgtcgtcctcgtggtatacaacaacactaccccggaccaaaccccccaactcttagtacttcatagaaactctactaacgccgtcctcgtagggtacttcgtagtatccgtcttctcgtcgcctaccgtcggtccggacaaccgaccggtccctcccgtagaactactcctcgtcgggcctccgacgccgtaggacggacgaggtacttaaattctttcttacgttcctatacttactacgtacgtttcgttggtttgggttcgggttaccggttcgggtaccgggtacgggtaccggtagggtaccggtaccggttcgtacggtcgaacgtaccgtacggtccgtaccggtccccgtcggtccgtaccgttccggttccgttccccggcccttacccg

SEQ ID NO: 17924 - DNA, 232 bp, Homo sapiens
  misc_feature: GYAE6OF01DQRD9.13.81.H04.1.454.CMB.1.raw
  modified_base (231)..(232): a, c, t, g, unknown or other
  misc_feature (231)..(232): n is a, c, g, or t
tcagtcacgtactacacgaccggtgctcgatttagtagtgtagattcgcgggcactttgatatctgggccaagggtcgatggtcatcgtctcttcagcctccaccaagggcccatcggtcttcccctggcgccctgctccaggagcacctccgagagcacagcggccctgggctgcctggtcaaggactacttcctagtacgtgactgagcgggctggcaaggcgcatagnn

SEQ ID NO: 17925 - DNA, 218 bp, Homo sapiens
  misc_feature: GYAE6OF01B3N3K.13.81.H04.1.454.CMB.1.raw
  modified_base (218)..(218): a, c, t, g, unknown or other
  misc_feature (218)..(218): n is a, c, g, or t
tcagtcacgtactacacgaccggtgctcgatttagtagtgtagattcgcgggatgaggccgactattactgtcaggtgtgggatagtagtcgtgagcatgtggtattcggcggagggaccaaactgaccgtcctaggtcagcccaaggctgccccctcggtcactctgttcccaccctcctctagtacgtgactgagcgggctggcaaggcgcatagn

SEQ ID NO: 17926 - DNA, 233 bp, Homo sapiens
  misc_feature: GYAE6OF01D2O08.13.81.H04.1.454.CMB.1.raw
  modified_base (232)..(233): a, c, t, g, unknown or other
  misc_feature (232)..(233): n is a, c, g, or t
tcagtcacgtactacacgaccggtgctcgatttagtagtgtagattcgcgggggcccaggcagaagatgaatctgattattactgtgttctttatatgggtagtgccatttctgctgtgttcggaggaggcacccggctgaccgtcctcggtcagcccaaggctgccccatcggtcactctgttcccaccctcctctagtacgtgactgagcgggctggcaaggcgcatagnn

SEQ ID NO: 17927 - DNA, 292 bp, Homo sapiens
  misc_feature: GYAE6OF01CO79E.13.81.H04.1.454.CMB.1.raw
  modified_base (288)..(292): a, c, t, g, unknown or other
  misc_feature (288)..(292): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatctcccgcatctgatagtacgtgactgagcgggctggcaaggcgcatagnnnnn

SEQ ID NO: 17928 - DNA, 297 bp, Homo sapiens
  misc_feature: GYAE6OF01CMRF1.13.81.H04.1.454.CMB.1.raw
  modified_base (291)..(297): a, c, t, g, unknown or other
  misc_feature (291)..(297): n is a, c, g, or t
tcagtcacgtactacacgaccggtgctcgatttagtagtgtagattcgcggggccactgacatcccagacaggttcagtggcagtgggtctgggacagacttcactctcaccatcagcacactggagcctgaagattttgcagtgtattactgtcagcagtatggtagctcacctcggacgttcggccaagggaccaaggtggaaatcaaaacgaactgtggctgcaccatctgtcttcatcttcccgcatctgatagtacgtgactgagcgggctggcaaggcgcatagnnnnnnn

SEQ ID NO: 17929 - DNA, 291 bp, Homo sapiens
  misc_feature: GYAE6OF01CYDMK.13.81.H04.1.454.CMB.1.raw
  modified_base (286)..(291): a, c, t, g, unknown or other
  misc_feature (286)..(291): n is a, c, g, or t
tcagtcacgtactacacgaccggtgctcgatttagtagtgtagattcgcgggactctggggtcccagacagattcagcgacagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatctccgcattgatagtacgtgactgagcgggctggcaaggcgcatagnnnnnn

SEQ ID NO: 17930 - DNA, 527 bp, Homo sapiens
  misc_feature: GYAE6OF01E1POV.13.81.H04.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
  modified_base (505)..(505): a, c, t, g, unknown or other
  misc_feature (505)..(505): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactggggaccagcagtgacgttcgtggtcaagactatgtctcctggtaccaacaacacccaggcaaggcccccaaactcataatttangatttcactaatcggccctnaggtntatctaatcgcttcactggctccaagtctggcaacncgcctccctgaccatctctgggctccaggcagaaggacgaggctgattattactgcggctcctggacgattagctaccctttatgtcttcgggacttgcgaaccaggtccaccgtcctagggtcagcccaaaggcccaacccntcgtacactctcgtccccaccc

SEQ ID NO: 17931 - DNA, 293 bp, Homo sapiens
  misc_feature: GYAE6OF01AJKJO.13.81.H04.1.454.CMB.1.raw
  modified_base (283)..(283): a, c, t, g, unknown or other
  misc_feature (283)..(283): n is a, c, g, or t
  modified_base (289)..(293): a, c, t, g, unknown or other
  misc_feature (289)..(293): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgcatctgatagtacgtgactgagcgggctggcaaggcncatagnnnnn

SEQ ID NO: 17932 - DNA, 295 bp, Homo sapiens
  misc_feature: GYAE6OF01AS4CD.13.81.H04.1.454.CMB.1.raw
  modified_base (293)..(295): a, c, t, g, unknown or other
  misc_feature (293)..(295): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnn

SEQ ID NO: 17933 - DNA, 293 bp, Homo sapiens
  misc_feature: GYAE6OF01BVNR4.13.81.H04.1.454.CMB.1.raw
  modified_base (283)..(283): a, c, t, g, unknown or other
  misc_feature (283)..(283): n is a, c, g, or t
  modified_base (289)..(293): a, c, t, g, unknown or other
  misc_feature (289)..(293): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcggctggcaaggcncatagnnnnn

SEQ ID NO: 17934 - DNA, 521 bp, Homo sapiens
  misc_feature: GYAE6OF01AFIJT.13.81.H04.1.454.CMB.1.raw
  modified_base (511)..(511): a, c, t, g, unknown or other
  misc_feature (511)..(511): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggctgacttccgccaacgcagggatattactcatctcgtgggctccagtctgacgatgagctgacttattactgtttgacttggcaacacacgtcctgactcgtcgacctcgggaccacggtccaccgtcctaggtcacgcccaaggccccaacccactcgtccncgtcgtcccg

SEQ ID NO: 17935 - DNA, 292 bp, Homo sapiens
  misc_feature: GYAE6OF01CNKOK.13.81.H04.1.454.CMB.1.raw
  modified_base (289)..(292): a, c, t, g, unknown or other
  misc_feature (289)..(292): n is a, c, g, or t
tcagtcacgtactacacgaccggtgctcgatttagtagtgtagattcgcggggccactgacatcccagacaggttcagtggcagtgggtctgggacagacttcactctcaccatcagcacactggagcctgaagattttgcagtgtattactgtcagcagtatggtagctcacctcggacgttcggccaagggaccaaggtggaaatcaaacgaactgtggctgcaccatctgtcttcatcttccgcatctgatagtacgtgactgagcgggctggcaaggcgcatagnnnn

SEQ ID NO: 17936 - DNA, 300 bp, Homo sapiens
  misc_feature: GYAE6OF01BFDJH.13.81.H04.1.454.CMB.1.raw
  modified_base (291)..(300): a, c, t, g, unknown or other
  misc_feature (291)..(300): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcaatagnnnnnnnnnn

SEQ ID NO: 17937 - DNA, 231 bp, Homo sapiens
  misc_feature: GYAE6OF01CF7BL.13.81.H04.1.454.CMB.1.raw
  modified_base (231)..(231): a, c, t, g, unknown or other
  misc_feature (231)..(231): n is a, c, g, or t
tcagtcacgtactacacgaccggtgctcgatttagtagtgtagattcgcgggggcccaggcagaagatgaatctgattattactgtgttctttatatgggtagtgccatttctgctgtgttcggaggaggcaccggctgaccgtcctcggtcagcccaaggctgccccatcggtcactttgttcccaccctcctctagtacgtgactgagcgggctggcaaggcgcatagn

SEQ ID NO: 17938 - DNA, 697 bp, Homo sapiens
  misc_feature: GYAE6OF01CXF11.13.81.H04.1.454.CMB.1.raw
  modified_base (283)..(283): a, c, t, g, unknown or other
  misc_feature (283)..(283): n is a, c, g, or t
  modified_base (400)..(400): a, c, t, g, unknown or other
  misc_feature (400)..(400): n is a, c, g, or t
tcagtcacgtactacacgaccggtgctcgatttagtagtgtagattcgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgactatatattggtaccgacagaagccaggggacgtccctcccctagttttcncctgacggttcaggtacaaactcagaataaacgacgagggctcgtgggacgtccccagcccgcttcgtctggactccgaaggctgacttccgacctaacgcgagggattacttaccnctattctcggtcgggcctacgtagttcgtagacgtatggacggcttgactttattaccgttggtttcgacgtttcggacctaacgtaaccgtaacggtcccgttaggggtaaccttccggtttaccgggaccggttacggggaaccccgttaccgggttacccgtaaaccccggggtttcccttaacggggtaccccgtaaccggtaccccccggtaaaaacgggtaccccccccttaaaacccccggttacgttaccgttaaccccgttaacccgtttcccggtttaaccccccgg

SEQ ID NO: 17939 - DNA, 554 bp, Homo sapiens
  misc_feature: GYAE6OF01BXNY4.13.81.H04.1.454.CMB.1.raw
  modified_base (420)..(420): a, c, t, g, unknown or other
  misc_feature (420)..(420): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctcccagtttctcctgaggttcaggtcaaactcagaataaacgacagggctcgtggacgtccccagccgcttctcgtggactaccaaggatgacttccgaccaacgcagggatagttactcatctcgtcgggctccgagtctgacgatggacgtntgacttattacgtgtttgacgttggcaacaacacgtcctggtacttcgttacggaccgtgggaccacggtaccaccgtcgtacggcacgacccaacggaccccaaccccacgtacgtcctactccgttacccgg

SEQ ID NO: 17940 - DNA, 621 bp, Homo sapiens
  misc_feature: GYAE6OF01DUHG6.13.81.H04.1.454.CMB.1.raw
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgacgttcgtggtcaaagactatgtctcctggtaaccaaacaacacccaggcaacggcccccaaactcataattatgtattcactaatcgcctgagtntatctaatcgcttcactgctacaagtcgtgacaacnccgcctcctgaccatctcgtcggcctccgaggcgaggaggacgtaggctagtaatttactacgtcggccgtcctccgtaggtacgtaagttacgtccttaacctttagtcgttacgttccgggtacttcgtacggaaccgtaacggtcccgaccgttaccgttaacggtccgtaaccggaccccgtaaaccggacccctaaacccccgtagttacccggttacctaccgtttcccgttcccgttcccccgttcccccg

SEQ ID NO: 17941 - DNA, 512 bp, Homo sapiens
  misc_feature: GYAE6OF01E00OB.13.81.H04.1.454.CMB.1.raw
  modified_base (481)..(481): a, c, t, g, unknown or other
  misc_feature (481)..(481): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggagtcctccccagtttctcctgaggttcaggtcaaactcagataaacgacagggctctgagtccccagccgcttctctggatccaaggatgattccgccaacgcagggatatactcatctctgggctccatctgacgatgaggctgactattactgtttgacttggcacaacacgcctggatcgttcggacctgggacctacgggtcaccggtcctaggtccngccccaaggcccaacccactgtcactctccg

SEQ ID NO: 17942 - DNA, 304 bp, Homo sapiens
  misc_feature: GYAE6OF01C15ZW.13.81.H04.1.454.CMB.1.raw
  modified_base (264)..(264): a, c, t, g, unknown or other
  misc_feature (264)..(264): n is a, c, g, or t
  modified_base (291)..(304): a, c, t, g, unknown or other
  misc_feature (291)..(304): n is a, c, g, or t
tcagtcacgtactacacgaccggtgctcgatttagtagtgtagattcgcgggactctgggggtcccagacagattcagcggcagtgggtcaggcactgatttcacattgaaaatcaccagggtggaggctgaggatggttgggatttattactgctatgcaagctacattctggcctttcactttcggccctgggaccaaagtggataccgaatcgaactgtggctgcaccatctgtcttcatctccgcatctgatagtacgtnactgagcggctggacaggcgcagtagnnnnnnnnnnnnnn

SEQ ID NO: 17943 - DNA, 294 bp, Homo sapiens
  misc_feature: GYAE6OF01E0M7P.13.81.H04.1.454.CMB.1.raw
  modified_base (289)..(294): a, c, t, g, unknown or other
  misc_feature (289)..(294): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtgctgcaccatctgtcttcatcttcccgccatctgatagtacgtgactgagcgggctggcaaggcgcatagnnnnnn

SEQ ID NO: 17944 - DNA, 730 bp, Homo sapiens
  misc_feature: GYAE6OF01DSZO1.13.81.H04.1.454.CMB.1.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccatgtctgggtctcctggacagtcgatcaccatctcctgcacgtaggaaatgcagtgatgttggacttagtcgtaccttgtctccgtcggtaccgacaaccacccgaggaccaaaccgcccccaaactctaatttagtttacgggtacaagtaacgccggccctacgtacggtctttcgtagacttcgtcttcgtcgtcggtctaccgaagttcgtacggacctaaccgacccggtcccttacccgtagaacctaacgtccttacgtacgggtaacccgtcccggaacgggacccggaacgggaccggtacgggttccgtttaaggtttaacgttttttacgttggttttacgttactaattagtcggtacggaaagggtaaggtacgttagttaagtttagttagttacggtttaaggaaggtcggtaaaccgtaggtaccgtaccgttcgttcggtaccgaaccggtcccgaaaccggacccctaaccccgtacgttacgttaccctaccgttacccgtttacccgtaccccccttcccgttcccgttaaccgg

SEQ ID NO: 17945 - DNA, 577 bp, Homo sapiens
  misc_feature: GYAE6OF01BJ1K6.13.81.H04.1.454.CMB.1.raw
  modified_base (313)..(313): a, c, t, g, unknown or other
  misc_feature (313)..(313): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcagtagggtcctgggcccagtctgccctgactcagcctgcctccgtgtctgggtctctggacagtcatccaccatcctcctgcacgtgggaccagcagtgtacgttcgtggtacaagtactatcgtcctctacggtaaccaacaaccaccagaccaacggaccccaaatcaataactttanagtatttcaactaactccgcctgagtgtactactaatcgtcttcacgtcgctacagtcgtgacacgcgcctccngactntctcgtcgctcgaganaggacgacgagtacngtaacttatacgngaccgtctacgtcgactatacgtcctaacgtttagtcgtacgttacgtattcggtactacgtacgtaccgtcccgtagtacgtccgacgacccgtaaggaccccctaacgcttactactaccgtcctccggtcccctaccc

SEQ ID NO: 17946 - DNA, 221 bp, Homo sapiens
  misc_feature: GYAE6OF01D1FWG.13.81.H04.1.454.CMB.1.raw
  modified_base (219)..(221): a, c, t, g, unknown or other
  misc_feature (219)..(221): n is a, c, g, or t
tcagtcacgtactacacgaccggtgctcgatttagtagtgtagattcgcggggatgaggccgactattactgtcaggtgtgggatagtagtcgtgagcatgtggtattcggcggagggaccaaactgaccgtcctaggtcagcccaaggctgccccctcggtcactctgttcccgccctcctctagtacgtgactgagcgggctggcaaggcgcatagnnn

SEQ ID NO: 17947 - DNA, 699 bp, Homo sapiens
  misc_feature: GYAE6OF01E4PCN.13.81.H04.1.454.CMB.1.raw
  modified_base (362)..(362): a, c, t, g, unknown or other
  misc_feature (362)..(362): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggagtccctccccagtttcctcctgacggttcaggtacaaactcagaataaacgacagggctcgtggacgtccccagccgtcttctccgtaggactaccgaaggntcgacttcccgacaacgcgagggtatacgttactctatcgtcgtcgggcctaccgtagttccgtacgaacgtagtggacgggtcttaggaactttaacgtttaccgtttggttttacggaccgtttaggacccaaacccgtaacgaaacccggtcccgtagggtacctttaccggttacccggggtaacccgttcggggaaccccgtaccgggttacccgtaccccggttacccgttaacgggtacccaacccgggtacccccgaaacccgggtaacccccctaaaccccccgtacctttaccggtaccccttaacccgttcccgtttaccccccgg

SEQ ID NO: 17948 - DNA, 605 bp, Homo sapiens
  misc_feature: GYAE6OF01DHAKA.13.81.H04.1.454.CMB.1.raw
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagtcacgtactacacgaccggtgctcgatttagtagtgtagattcgcggggggggtcacaagaggcagcgctctcgggacgtctccaccatggcctgggctctgctgctcctcactctcctcactcaggacacagggtcctgggcccagtctgccctgactcagcctgcctcatgtctgggtctctggacagtcgatcaccatctctgcaacgtggaaacngcagtgatcgttggacttatagacttgctcgtagtaaccaacaccaccgaggcaacggccccagagtcatcagtttagngggacaagtaggcgtccgtagaggtactttccatcgctttcncgtggctacgaagtcacgacaacgccggtcctccagactaactctcgtcggtcctaccgacggtctaggaacggacgagggctcggtactaacgttacgtcgtcgtacgtctactagtactcgtcgtacggtttcttcgttggttcggtcggtttcgggacgggttacgggtaacccgtaaaggtccgtaaccgttcccggtacggtaccgtaccgaacccgtaacgggcctacccggcccccggttcgtaccgttacccg

SEQ ID NO: 17949 - DNA, 581 bp, Homo sapiens
  misc_feature: GYAE6OF01A7ZBV.13.81.H04.1.454.CMB.1.raw
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcaggacacagggtcctgggcccagtctgccctgactcagcctgcctccatgtctgggtctcctggacagtcgatcaccatctcctgcactggaaatagcagtgatgttgggacttangaccttgtctcctggtaccgacaacacccagcaaacgcccccaaactcattatttacggggtcaataagcggccctcagggctttctgatcgcttctcgtggctccaagtctggcaacgcgccgtcctgacatctctggactccaggccgaggacgagctggtacttttacgngttgtcatatgctaagggagtagtgtattagttgtacgtttgggaagtcggacctaacgggttcaccggttccgttggtacccacggacccgtaaggccccaaacccccgtaacgtcgtaccgaacccttcgtacccggttcccccgtccccgttccttacccgg

SEQ ID NO: 17950 - DNA, 229 bp, Homo sapiens
  misc_feature: GYAE6OF01EB3ZT.13.81.H04.1.454.CMB.1.raw
  modified_base (216)..(229): a, c, t, g, unknown or other
  misc_feature (216)..(229): n is a, c, g, or t
tcagtcacgtactacacgaccggtgctcgatttagtagtgtagattcgcggggatgaggccgactattactgtcaggtgtgggatattagtcgtgagcatgtggtattcggcggaggaccaaactgaccgtcctaggtcagcccaaggctgccccctggtcactctgttcccgccctctctagtacgtgactgagcgggctggcaaggcgcaatgnnnnnnnnnnnnnn

SEQ ID NO: 17951 - DNA, 637 bp, Homo sapiens
  misc_feature: GYAE6OF01EXEMP.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtggcaccatgttggtccctatgacatatattggtaccgacagaacgccgagggacgtccctccctagtttcctcctgtcggttcaggtacaaactcaagataaacgacacgggctctggacgtcccgacgccgtcttctcgtgactaccgaaggtactgtacttcccgaccaacgcgaagggtatagttactacattcctcgtcgggtcctcgtagtctagacgtagtggacgtcgtacgtaactttatttaccgttgtttacgtacgtttcggactaacgaaccgaacgtaccgttaggtacttccgttaccggaccgttacgggacccgtaccggtccgtacccggttccgttacggtaccgaccgaccccgtaaaccggaccccgtaaacccgtaccgttaccgtaccttacccgtccgttacccccgg

SEQ ID NO: 17952 - DNA, 294 bp, Homo sapiens
  misc_feature: GYAE6OF01EI6S0.13.81.H04.1.454.CMB.1.raw
  modified_base (290)..(294): a, c, t, g, unknown or other
  misc_feature (290)..(294): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnn

SEQ ID NO: 17953 - DNA, 304 bp, Homo sapiens
  misc_feature: GYAE6OF01ELKPM.13.81.H04.1.454.CMB.1.raw
  modified_base (280)..(280): a, c, t, g, unknown or other
  misc_feature (280)..(280): n is a, c, g, or t
  modified_base (297)..(304): a, c, t, g, unknown or other
  misc_feature (297)..(304): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctccgctcaccttcggccaagggacacgactggagatagaacgaactgtggctgccaccatctgtcttcatccttcccgcctatctgatagtacgtgactgagcgggntggcaaggcgcataggnnnnnnnn

SEQ ID NO: 17954 - DNA, 707 bp, Homo sapiens
  misc_feature: GYAE6OF01CL9RD.13.81.H04.1.454.CMB.1.raw
tcagtcacgtactacacgaccggtgctcgattttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcctaccttgccgcagtggacacctaattggttcggtccctatgacatattagttcggtaccgacgagaagccgagggacgtccctccctagttttctccgtgtaggttcaggtacaaactcagaacgtaaacgacgacgggtctcgtggaccgtcccacgccgtcttcgtcgtacgactacgaaggtatcgtacgttacccgaccaacggtcgaacgggtacttaactttaccgtacttactaccgtccgttacgggccttaccgacgttacgtacgacgagtgggacgtcgttacgtaacttttacgttacgttttggtttacgttacgttacggtaaccaaaccgtaaccgtaacccgtccgttacgtacgttccggttaccgggtaccggtaccggggtaaccctaccggtacccttaccgggttaccgtacgggtacccgacccgtaaccccggaacccggtacccctaaccctaccgttccgtaacccttccgttccgttaccccgg

SEQ ID NO: 17955 - DNA, 695 bp, Homo sapiens
  misc_feature: GYAE6OF01B0143.13.81.H04.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgttcttccctctctgcttctcctggagcgtcagccagtctcacctgcaccttgcgcagtggcactaagttgttcgtcctangtacatatagttcggaaccacaaggaacgaccgagggacttccctacccgtagtttcctccgtagtacggttnaacggttacaactacgaagtaataaaaccgcgaaggtctcgtaggacctcccgacgccgtacttctcgtaggactacgaaggactacgacgttcccgaccgaacggacgaaggaactttacgtacctacgtaactccgttacgtgggtccttaccgtaagtcccgtaagtacgaacgttaggaacggtcgttaacggtaacctttaacgtttattaggtttacgtacggttacgaaccgtaacaacgtaaaccgtccgtaggttaacctacggtaccgggtaaccgtcgggtaacccaacgggttacccaccggttccgttaaggcccgaacggaccccgaaacgggttccccaaaacccgtcttaccgacccgttactcggtttaaccccc

SEQ ID NO: 17956 - DNA, 710 bp, Homo sapiens
  misc_feature: GYAE6OF01EAND7.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgttcttccctctctgtccttctccgtggacgcgtacacgcctagtctccaccttgcctaccgttgccgcaggtcgaccaacctagttcggttcgtccctatcgactattattacgttcggtaccgaagaaggaacgccggacgggtaccttcccctacccgttagtttccctcggtaggtcggttaccgacggtaacctaaaccgtcgaaagtaaaccgtaaacggcggtaacgggtcccttacggtacgggacccgtaccccgacgtcccgttccttacgtcggtacggaacctaccgaaggtctacggtaccgtacccgacgtaacgacggtaaggtacttaccttactcgtaccttcgtcggtacggtctacgtacgtcgtacgacgtgacgtcgtcgttacgtacgtttcttacggtttgttacgtactcgaacctaactaaccgtacgtccgttacgcttccggtaccggtccgtaccggaccgtccgtccgtaaccgtcgtacgacgacccgaccgaaccgtacccctacgtactcctacctccgttcgtccccg

SEQ ID NO: 17957 - DNA, 384 bp, Homo sapiens
  misc_feature: GYAE6OF01EWC8V.13.81.H04.1.454.CMB.1.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (312)..(314): a, c, t, g, unknown or other
  misc_feature (312)..(314): n is a, c, g, or t
  modified_base (316)..(316): a, c, t, g, unknown or other
  misc_feature (316)..(316): n is a, c, g, or t
  modified_base (319)..(384): a, c, t, g, unknown or other
  misc_feature (319)..(384): n is a, c, g, or t
tcagtcacgtactacacgaccggtgctcgattttagtagtgtagattcgcgggactctgggggtcccagacagattcagcggcagtgggtcaggcactgatttcacactgcaaatcagcagggtggaggctgaagatgttgggattttattattgcatgcaaggtgcactctggtctatgtggacgttcggccaagggaccaaggtggaaaatcaaaacgactggngctgcaccatctgtcttcatcctcccgcatctgatagtacgtnactggacgcgggtctaggacgtaacgggcgacgtaagtacggnnnancannnnnnnnnnnnnnnnnnnnnnnnnnnnnnnnnnnnnnnnnnnnnnnnnnnnnnnnnnnnnnnnnn

SEQ ID NO: 17958 - DNA, 734 bp, Homo sapiens
  misc_feature: GYAE6OF01EMID2.13.81.H04.1.454.CMB.1.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgcctgactcagcctgcctcgtgtctgggtctcctggacagtcgatcaccatctcctgcacgtgggaccagcaggtcgacgttcgtggtcaagactatcgtctcctaggtaccaacaacacccagaccaacggacccccaaatcaattaatttagtagtacttcaactaacgtccggtacctacgtaggttatatactaatcgtacttacacgttaggacctacaaggttccaggtaccaaaccgtccggtcccttacccgtacgaaacccagtttccgtccggtacggggccctaccggtaaggaccgtaagggaacgggtacccgtagggtaccttaggttaaactttacgtttaccggtcggaccggttccctaccggtaggtaacgttacgtttacggacctttacccggttttagtcggttacccgttacgggtacttcgggtaaccgtaaccgtaacggtacccgtacccggttaccgtaccgggtaccaaccgggtaccctaacccgggacccctaaaccccgtacgttccctacccgtaacccgtttccgttaccccgttcccccggtaaccc

SEQ ID NO: 17959 - DNA, 744 bp, Homo sapiens
  misc_feature: GYAE6OF01CBXSO.13.81.H04.1.454.CMB.1.raw
  modified_base (217)..(217): a, c, t, g, unknown or other
  misc_feature (217)..(217): n is a, c, g, or t
  modified_base (374)..(374): a, c, t, g, unknown or other
  misc_feature (374)..(374): n is a, c, g, or t
tcagtcacgtactacacgaccggtgctcgatttagtagtgtagattcgcggggggggtctcaggagggcagcgctctcgggacgtctccaccatggcctgggctctgctattccctcaccctcctcactcaggggcatagggtcctgggcccagtctgccctgactcagcctgcctcgtgtctgggtctccgtggacagtcgactcaccatcctccngcacgtcgggaccagcagtgtacgttgtgtacaaggctagtcgtctccgtacgtaaccaaccaccaacccgagaccgaaaccgaccccctaaactactaataattactgtacttacactaacgtccgaccctgagtgttactactacgtcgtactcncgtacgctactacgtctacggaccaacgccgtccctaccgttacgacctacgttcctcggtccgggtacctccggaccgggtacgaacgggacggaaccggtacggtacgttagtaacgtttacgttaccgtacggtcccgtaccggtttcccggtaggtaaccgtaacgttacggtacccttaacccgttttaggtccggtttacccgggttacgggttaccgttcggtaaccgtaaccggtaccggttacccgtacccgttacccggtaaggtacccgacccggtaaaccccgttaaacggaacccccctaaccgcccggttacctacccgttaccgtttacccgttccccttaacccccgtcccccg

SEQ ID NO: 17960 - DNA, 687 bp, Homo sapiens
  misc_feature: GYAE6OF01A4YVX.13.81.H04.1.454.CMB.1.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggctcagtctgccctgactcagcctcgctcagtgtccgggtctcctggacagtcagtcaccatctcctgcactggaaccagcagtgatggttggtagttaataactatcgtctccgtaggtaaccaacaaccacccaggacaaaccgaccccaaaatccaatgtactttagtgtatcgtacaagtaacgccggtcctacggacgggtcccctgactccgtcttctctcgcctacctaagtcgtcggacctaacgcccgtcctcccgtacgaccctacgtccgttcggtacggcccttaccgacggtcgtaggacggtatacggtacgttctagttacgtttaattaccgtcgtcgttacgtaccttacgtaagttcgtaccgacggtacggaccgttaaccgtaccgttaacctaccgttacgttaccggttaaccggttaccggggaccgggtaacgggtaacccgaacggttcccgtaccgggtacccggttacccgtacggtacccgaccgggtaaccccgtacggcccgttacccccgg

SEQ ID NO: 17961 - DNA, 983 bp, Homo sapiens
  misc_feature: GYAE6OF01DZHF1.13.81.H04.1.454.CMB.1.raw
  modified_base (142)..(142): a, c, t, g, unknown or other
  misc_feature (142)..(142): n is a, c, g, or t
  modified_base (206)..(206): a, c, t, g, unknown or other
  misc_feature (206)..(206): n is a, c, g, or t
tcagtcacgtactacacgaccggtgctcgatttagtagtgtagattcgcggggggtaagaggttgtgtccaccatggcctggactcctctcctcctcctgctcctctctcactgcactacggttccctctcgcaggtctgtnctgactcgacgtcccttccttccctctcttcgtccttcctcgtggacgtcgtcacgccagtccnctacgtcgacctcgttcgcgtcgtacggtcgtacctaacgtagtttcggttccgtacctagacgtaactagttaagttacggttacggaaccgaaggaacggtaaccggtccggaacgggtttccccttcccccgttacccggtttgtttacccgttccggtacggggtttaaccggtacccgttaacgtaaaaccgaaccttaacggaaaaccgggtttaaaccgaaaaccgggtaaccggggtccggttacccggttttaaccgggttacccgggaaacccccgttcccccggggtaccttccccgggttttaccttttcggtaacccggtaacggttaaaccccgaacggttacgggttaccttaaccgggttcccctaaacccggtaccgggtaacgtacgggtaaacggtttacttttacccgttacggtaccttacccggttccgggtttacggtaccgggttacctttacccgggttaaccgttaggtaaccggtaaccggttagggtacgggttaccgttaccgttaacgtttaccttttaacggttttcccgttttaggtttacggttacccgtacgtaaaccgtaacccgtaccgtaccggtcctttaacggtccgtttaccgggaccggtaccggacccggttaccgtacccggttacctacgggttaacccggtacccgaaccggtaacccggcccggtaaccccgtacccccgtaaccgtcccgtttacccgtaccccgttacccggtttccccgtacccccgg

SEQ ID NO: 17962 - DNA, 696 bp, Homo sapiens
  misc_feature: GYAE6OF01CNHUR.13.81.H04.1.454.CMB.1.raw
  modified_base (208)..(208): a, c, t, g, unknown or other
  misc_feature (208)..(208): n is a, c, g, or t
tcagtcacgtactacacgaccggtgctcgatttagtagtgtagattcgcgggggtaaggaggtgtgtccaccatggcctggactcctctcctcctcctgctcctctctcactgcacaggttccctctcgcaggctgtgctgactcagccgtccttcctctctgcttctctggagcgtcagccagtcctcacctgcctaccgtgcgacngtggcactaagtgttcgtcctatgactatagtagttacggtaccaacgaggaacgtccggagggtaccgtaccccttcccgtagtttcctccgtaggacggttaccgaacggttaaccaacgttacgaagtaaacgtaaaccgacggacggtcttacggtacggacccgtacccgacgtccgtaccttcgtccgtgtacctaaccggtaggtcttacgtaccttacccgaccgaaggccgaaggttacgttaacctcgtactacttcgtcggtacgtccgtacgaagttcacggtactacgggtagacgggtcctaggttaacttttacttacggtttcgtttagaccgttcggaacctaaacggtaacccgacggtcggttagtaaccgttcgacggtaccggtacgtaacccgtcgtcccgtaccggttcacgggtaccacccgaccggaacacccctaccacgtcaacccgttcgtcgttccccg

SEQ ID NO: 17963 - DNA, 735 bp, Homo sapiens
  misc_feature: GYAE6OF01BC83G.13.81.H04.1.454.CMB.1.raw
  modified_base (676)..(676): a, c, t, g, unknown or other
  misc_feature (676)..(676): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcaggtggcaccaatgttcggtccctatgactatatagttaggtaccgacaggaacgccgagggactccctcccctagtttcctcgtgtacggtcaggtacaactcaagaactaaacggacgaggtctcgtggaccgtccccgagtccgtcttccgtcgtacggtactaccgaaaggtacttacgtacgttccccgaaccgaacggtacgtaaggggtaactttaacgttaccgtaccgttaacttccgttaccgggtacgggttccctacccgtaggttaccctagggtaaccggtaggtcggtaacgggtcgttacggttaaccttttagtttaccggtttggttttaccggtaacgtttcgggaaccctaaacgtaaccgaacccggttacgtacgggtaaccttccggttacccgggtaccgggtaccggtacccgtacggtacccgtacccggttccgtacgggtaccncccggtaaccccgacgacccccacccgtacgtccgacttacccgttccgttacccccgg

SEQ ID NO: 17964 - DNA, 243 bp, Homo sapiens
  misc_feature: GYAE6OF01A5ESL.13.81.H04.1.454.CMB.1.raw
  modified_base (222)..(243): a, c, t, g, unknown or other
  misc_feature (222)..(243): n is a, c, g, or t
tcagtcacgtactacacgaccggtgctcgatttagtagtgtagattcgcggggatgaggccgactattactgtcaggtgtgggatagtagtcgtgagcatgtggtattcggcggaggaccaaactgacccgtcctaggtcagcccaaggctcgccccctggtcactctcgttcccgccctcctctagtacgtgactgagcgggtctggcaaggcgcaatagnnnnnnnnnnnnnnnnnnnnnn

SEQ ID NO: 17965 - DNA, 217 bp, Homo sapiens
  misc_feature: GYAE6OF02F4VQF.13.81.H04.1.454.CMB.1.raw
  modified_base (217)..(217): a, c, t, g, unknown or other
  misc_feature (217)..(217): n is a, c, g, or t
tcagtcacgtactacacgaccggtgctcgatttagtagtgtagattcgcgggatgaggccgactattactgtcaggtgtgggatagtagtcgtgagcatgtggtattcggcggagggaccaaactgaccgtcctaggtcagcccaaggctgcccctcggtcactctgttcccgccctcctctagtacgtgactgagcgggctggcaaggcgcatagn

SEQ ID NO: 17966 - DNA, 294 bp, Homo sapiens; identical to SEQ ID NO: 17952
  misc_feature: GYAE6OF02FMTJC.13.81.H04.1.454.CMB.1.raw
  modified_base (290)..(294): a, c, t, g, unknown or other
  misc_feature (290)..(294): n is a, c, g, or t

SEQ ID NO: 17967 - DNA, 512 bp, Homo sapiens
  misc_feature: GYAE6OF02GTKUP.13.81.H04.1.454.CMB.1.raw
  modified_base (420)..(420): a, c, t, g, unknown or other
  misc_feature (420)..(420): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggatccgaaggatgacttccgccaacgcagggatatactcatctctgggctcagtctgacgatgagctgacttattactgttnacttgcacaacacgcctggactcgtcggacctgggaccacggtcaccgttctaggtcacgcccgaaggcccaaccctactgtccactctccg

SEQ ID NO: 17968 - DNA, 293 bp, Homo sapiens
  misc_feature: GYAE6OF02GQ4E5.13.81.H04.1.454.CMB.1.raw
  modified_base (290)..(293): a, c, t, g, unknown or other
  misc_feature (290)..(293): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnn

SEQ ID NO: 17969 - DNA, 295 bp, Homo sapiens
  misc_feature: GYAE6OF02I14BU.13.81.H04.1.454.CMB.1.raw
  modified_base (290)..(295): a, c, t, g, unknown or other
  misc_feature (290)..(295): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnnn

SEQ ID NO: 17970 - DNA, 294 bp, Homo sapiens; identical to SEQ ID NO: 17952
  misc_feature: GYAE6OF02GZCSG.13.81.H04.1.454.CMB.1.raw
  modified_base (290)..(294): a, c, t, g, unknown or other
  misc_feature (290)..(294): n is a, c, g, or t

SEQ ID NO: 17971 - DNA, 296 bp, Homo sapiens
  misc_feature: GYAE6OF02HNA61.13.81.H04.1.454.CMB.1.raw
  modified_base (293)..(296): a, c, t, g, unknown or other
  misc_feature (293)..(296): n is a, c, g, or t
tcagtcacgtactacacgaccggtgctcgatttagtagtgtagattcgcggggccactgacatcccagacaggttcagtggcagtgggtctgggacagacttcactctcaccatcagcacactggagcctgaagattttgcagtgtattactgtcagcagcgtagcaactggcctccggccctttcggcggagggaccaaggtggagatcaaacgaactgtggctgcaccatctgtcttcatcttcccgccatctgatagtacgtgactgagcgggctggcaaggcgcatagnnnn

SEQ ID NO: 17972 - DNA, 509 bp, Homo sapiens
  misc_feature: GYAE6OF02GE48B.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattcgccaacgcagggatatactcatctctgggctccagtctgacgatgaggctgactattactgtttgactttggcacaacaacgctggatcttcggacctgggaccacggtcaccgtcctaggtcacgcccaaggcccaacccactgtcacctctccg

SEQ ID NO: 17973 - DNA, 230 bp, Homo sapiens
  misc_feature: GYAE6OF02FI538.13.81.H04.1.454.CMB.1.raw
  modified_base (230)..(230): a, c, t, g, unknown or other
  misc_feature (230)..(230): n is a, c, g, or t
tcagtcacgtactacacgaccggtgctcgatttagtagtgtagattcgcgggcccaggcagaagatgaatctgattattactgtgttctttatatgggtagtgccatttctgctgtgttcggaggaggcacccggctgaccgtcctcggtcagcccaaggctgccccatcggtcactctgttcccaccctcctctagtacgtgactgagcgggctggcaaggcgcatagn

SEQ ID NO: 17974 - DNA, 295 bp, Homo sapiens
  misc_feature: GYAE6OF02HK7BE.13.81.H04.1.454.CMB.1.raw
  modified_base (289)..(295): a, c, t, g, unknown or other
  misc_feature (289)..(295): n is a, c, g, or t
tcagtcacgtactacacgaccggtgctcgatttagtagtgtagattcgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgcctctgatagtacgtgactgagcgggctggcaaggcgcatagnnnnnnn

SEQ ID NO: 17975 - DNA, 218 bp, Homo sapiens
  misc_feature: GYAE6OF02G9W7T.13.81.H04.1.454.CMB.1.raw
  modified_base (218)..(218): a, c, t, g, unknown or other
  misc_feature (218)..(218): n is a, c, g, or t
tcagtcacgtactacacgaccggtgctcgatttagtagtgtagattcgcgggatgaggccgactattactgtcaggtgtgggatagtagtcgtgagcatgtggtattcggcggagggaccaaactgaccgtcctaggtcagcccaaggctgccccctcggtcactctgttcccgccctcctctagtacgtgactgagcgggctggcaaggcgcatagn

SEQ ID NO: 17976 - DNA, 231 bp, Homo sapiens
  misc_feature: GYAE6OF02ILNTI.13.81.H04.1.454.CMB.1.raw
  modified_base (226)..(231): a, c, t, g, unknown or other
  misc_feature (226)..(231): n is a, c, g, or t
tcagtcacgtactacacgaccggtgctcgatttagtagtgtagattcgcggggcccgaggcagaagatgaatctgattattactgtgttctttatatggtagtgccatttctgctgtgttcggaggaggcaccggctgaccgtcctcggtcagcccaaggctgcccatcggtcactctgttcccgcctctctagtacgtgactgagcggctggcaaggcgcatagnnnnnn

SEQ ID NO: 17977 - DNA, 218 bp, Homo sapiens
  misc_feature: GYAE6OF02JHVRP.13.81.H04.1.454.CMB.1.raw
  modified_base (215)..(218): a, c, t, g, unknown or other
  misc_feature (215)..(218): n is a, c, g, or t
tcagtcacgtactacacgaccggtgctcgatttagtagtgtagattcgcgggatgaggccgactattactgtcaggtgtgggatagtagtcgtgagcatgtggtattcggcggaggaccaaactgaccgtcctaggtcagcccaaggctgcccctcggtcactctgttcccaccctcctctagtacgtgactgagcggctggcaaggcgcatagnnnn

SEQ ID NO: 17978 - DNA, 310 bp, Homo sapiens
  misc_feature: GYAE6OF02HSG4L.13.81.H04.1.454.CMB.1.raw
  modified_base (294)..(310): a, c, t, g, unknown or other
  misc_feature (294)..(310): n is a, c, g, or t
tcagtcacgtactacacgaccggtgctcgatttagtagtgtagattcgcgggactctgggggtcccagacagattcagcggcagtgggtcaggcactgatttcacattgaaaatcaccagggtggaggctgaggatgttgggatttattactgctatgcaagctacattctggcctttcactttcggccctgggaccaaagtggataccgaatcgaactgtggctgcaccatctgtcttcatcttccgccatcctgatagtacgtgactgagcgggctggcaaggcgcataggnnnnnnnnnnnnnnnnn

SEQ ID NO: 17979 - DNA, 293 bp, Homo sapiens; identical to SEQ ID NO: 17968
  misc_feature: GYAE6OF02F47NR.13.81.H04.1.454.CMB.1.raw
  modified_base (290)..(293): a, c, t, g, unknown or other
  misc_feature (290)..(293): n is a, c, g, or t

SEQ ID NO: 17980 - DNA, 528 bp, Homo sapiens
  misc_feature: GYAE6OF02HGPZI.13.81.H04.1.454.CMB.1.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (463)..(463): a, c, t, g, unknown or other
  misc_feature (463)..(463): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccccagtttctcctgaggttcaggtcaaactcagataaacgcaggctctggagtccccagccgcttcnctggatccaaggntgattccgccaacgcagggatatactcatctctgggctccagtctgacgatgagctgacttattactgtttgacttggacacaacacgcctggacttcgttacggaccttgggaccncggtccaccggtcctaggtccacgcccgaaggcccaaccccgacgtcgtacctactccttcccgg

SEQ ID NO: 17981 - DNA, 588 bp, Homo sapiens
  misc_feature: GYAE6OF02GU2SH.13.81.H04.1.454.CMB.1.raw
tcagtcacgtactacacgaccggtgctcgatttagtagtgtagattcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagccccaaaatcaatgatttatgatgtcagtaagcggccctcgacggggtccctgactcgcttctctcgcctacaagtcgtacggacaaccgaccggtccctcccgtacgacctactcctccgtcgggtacctccgaggtcgtggaagtacgtgtacgtcgtagtaactttacttactgtactcgtctactatagttcgacgtagcaacgtacctaacgtacttagttaacgtacggttcgggaacgggtacggaacctaaggtccgtaccggtaccgtaccgttacggccgtaccgacccgtaaccggg

SEQ ID NO: 17982 - DNA, 333 bp, Homo sapiens
  misc_feature: GYAE6OF02IZFSM.13.81.H04.1.454.CMB.1.raw
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (314)..(333): a, c, t, g, unknown or other
  misc_feature (314)..(333): n is a, c, g, or t
tcagtcacgtactacacgaccggtgctcgatttagtagtgtagattcgcgggacgtctggggtcccagacagattcagcggcagtgggtcaggcactgatttcacattgaaaatcaccagggtggaggctgaggatgttgggatttatactgcatgcaaagctacattcgtggcctttcactttcggcccctggggaccaaagtggataccaatcgaactgtggcggacacactctcgtctactctccgtcccaccntcgtgtatagttacgtagacgtcgacggcggcgtcggacgaacggcggtccaanagnnnnnnnnnnnnnnnnnnnn

SEQ ID NO: 17983 - DNA, 567 bp, Homo sapiens
  misc_feature: GYAE6OF02GRIQH.13.81.H04.1.454.CMB.1.raw
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcccctatgacatatattggtaccgacagaagccagggagtcctcccagtttcctcctgacggttcaggtcaaactcagataacganagggctcgnggacgccccagccgcttctctggactccaaggntgattccgacctaacgcgagggtatacttacnctatctcgtcgggtcctcgagttctgaccgtatgacgngttgacttattactgtttagacttggacacaactaaccgcctagtactccgtcggaccgttcggacctacggcctaccggttccacgggttccaacggccccgaaaggtccccaacccgtagtaccggtacctaccgtgtacccccg

SEQ ID NO: 17984 - DNA, 527 bp, Homo sapiens
  misc_feature: GYAE6OF02IDGO8.13.81.H04.1.454.CMB.1.raw
  modified_base (426)..(426): a, c, t, g, unknown or other
  misc_feature (426)..(426): n is a, c, g, or t
  modified_base (510)..(510): a, c, t, g, unknown or other
  misc_feature (510)..(510): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccgacagaagccagggagtcctccccagtttctcctgaggttcaggtcaaactcagataaacgacagggctcgtggacgtccccagccgcttctctggatccaaggatcgattccgccaacgcaggggatagttactcatctctgggctcagtctgacgatggagctgacttattactgtttnacttggacacaacaacgcctaggattccgtcggacctgggacctacggtccaccgtcctaggtccacgcccaaggcccaacccnctgtccactcttacccg

SEQ ID NO: 17985 - DNA, 554 bp, Homo sapiens
  misc_feature: GYAE6OF02JKSA1.13.81.H04.1.454.CMB.1.raw
  modified_base (363)..(363): a, c, t, g, unknown or other
  misc_feature (363)..(363): n is a, c, g, or t
tcagtcacgtactacacgaccggtgctcgatttagtagtgtagattcgcgggggggtctcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccaccaggcaacggcccccagacgtcatcatttatggggcaataggcggccgtcagggactttccactcgcttctctggctccaagtctggacaacnccggcctcctgacaatctactggtctccaggctggaggacgacggtctgtccttaattacgtcgctcgtctccatacgtgacgtaggtttcctcgttgtcggttcgttcgggcggtacggtaccaaggttcgaaccggttctacggtcacgtccgtacggcctccggaccccgtcggtacctaccgttccg

SEQ ID NO: 17986 - DNA, 526 bp, Homo sapiens
  misc_feature: GYAE6OF02FZ44V.13.81.H04.1.454.CMB.1.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (502)..(502): a, c, t, g, unknown or other
  misc_feature (502)..(502): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttangatttcactaatcggcctnaggtntatctaatcgcttcactggctcaagtctggcaacncggcctcctgaccatctctgggctccgaggcagaggacgaggctgattattactgcgctccgtggacattacgcctaccctttatcgttcttcgggactgtcgaccagtccacgtctaggtcacgcccaaggcccaacccgtntcgtccactctccgtcccctaccc

SEQ ID NO: 17987 - DNA, 681 bp, Homo sapiens
  misc_feature: GYAE6OF02GFAH2.13.81.H04.1.454.CMB.1.raw
  modified_base (206)..(206): a, c, t, g, unknown or other
  misc_feature (206)..(206): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctcgtcttctcctggacgcgtcagccagtctcacctgcaccttgcncagtgcaccaatgttcgtcctatgacatagtattcggtaccgacagaacgccgagggtacgtccctccctagtttcctcctgaggttcacggtacaaactcagtaataaacgacgagggtctcgtggaccgtccccgagccgtcttctcgtggactaccgaagtcgtacgtacttcccgaccaacgccgaagggtacttagttacctataatctccgtagggtcctccgtagttccagacgtagtcggaggtacttacgtaactttagtttaccttggtttacgtacttcggacctaaacgtaaaccgtaccgtccgttagacgtttaccgtaccgggtaaccgtaccgggaaccgtaccgggtaacccgttacccggtcccgttaaaggtccccgtaaaccggtaccccggtaaaccggacccccgtaaaccccgtacgttacccggtaacccttacccgttcccgttaccccg

SEQ ID NO: 17988 - DNA, 933 bp, Homo sapiens
  misc_feature: GYAE6OF02IQR3W.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgccaccttgcgcagtggcaccgaatgttcggtccctagtcgacatatagttcggtaccgacagaacgccgaaggggtcttacccctccccgtaacggttttcctacccgtaggtacggtttaccacgggttaccaaaaccgtccgaaggtaacgttaaaaccggaccgtaacggggtccttaccggttagggtaaccccggttacccccgaaacgggtcccccggttacccgttttacctaccgggttacgggtaacccgttaacccgggaaaacggggttacgttaaccgggtttaaacccgttttacccccgggaaaccccgtaaaccgggtaccggtaaaacgggggttaactttaaacgtttaaacccgttaccgtaacgttttaaccccgttcggttaacgggggtaccccttacccgggtaaacgtttccgttaacggtaaacccgtaacgggttcgggtaacgggttaccgttaacgggtaaacccttttaagttttacccggttaggtttttaaccggaaccgttttacgggaacctaaacccgtaaacccgaacccggtccgttaacgggttacctttccggttacccggaccggtaccgggtaaccccgtacggttacccgtaccccgggtttacgtaacccgggttaccgaaccggtacccccggaaacggtcccccgtaaaccccgtccggttaccctacccggtacccctttccgttaaccccccgg

SEQ ID NO: 17989 - DNA, 741 bp, Homo sapiens
  misc_feature: GYAE6OF02GTX8K.13.81.H04.1.454.CMB.1.raw
  modified_base (247)..(247): a, c, t, g, unknown or other
  misc_feature (247)..(247): n is a, c, g, or t
  modified_base (394)..(394): a, c, t, g, unknown or other
  misc_feature (394)..(394): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccagggacgttccctccccctagttttcctcctggtacggttccaagggttaccaaacctcgaagtaacgtaaaaccggacgaagggtcctcgtgggaccgtccccaggcccgtacttctcgtggtaactaccgaaagggtntacgtacgttcccgaccgaaaccggcgtaaaggggtacttaacgttaacctacctaacttcccgtcggtacggggtacccttacccgtaaggttccgtaaggaccgtaagtcgggtaaacgggtccttacggtaaacgtttacgttttaaccgttgggttttacgaaccgttttcggaaactaaccgaaaccgtaccgtccgtaggtttactccggtttacggacccgtcggggtaaccctccgggttaccgtaccccgttaccggtaacggttcccgaacgtaccccgaaccggtaaccccctaaccccggtacgttccggtaccctaccgttacccgttcccccg

SEQ ID NO: 17990 - DNA, 719 bp, Homo sapiens
  misc_feature: GYAE6OF02GHZHK.13.81.H04.1.454.CMB.1.raw
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (418)..(418): a, c, t, g, unknown or other
  misc_feature (418)..(418): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcagtggcaccaatgttcggtccctatgacatatattcggtaccganagaacgccgaggggactcctccctagtttcctccgtagtaggttccaggtaccaaacttcaagaataaaccgngacggctgtgacgtcccagtccgcttctacgtgactaccgaaggtactgtaaccgttcccgaccgaaacgcgaacgggtaattaacgtttaaccncgtaacttccgttacgtcgggtaccctccgtaacgttcgtaacggacgtacgtaggacgggtccttagtaactttagtttaccgttgtttacggtacctttacgggacctaaactaacccgtaaacgtccgtcggtaacgttccgttaccgggtaacccgtacggggtaacccgtaccggttaccggtaacccgggttccccgtaacggggttacccgtaaccggtaacccccggtaacgggtaaccccccgaaacccccttacggttcccgtaacccggtaccgttacccgttcccccgg

SEQ ID NO: 17991 - DNA, 711 bp, Homo sapiens
  misc_feature: GYAE6OF02I8F2M.13.81.H04.1.454.CMB.1.raw
  modified_base (671)..(671): a, c, t, g, unknown or other
  misc_feature (671)..(671): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctcgtgtctgggtctcctggacagtcgatcaccatctcctgcacgtcgggaccagccagtgtacgttcgtggacaagctatcgtcctcctggtaccaacaaccacccgaggaccaacggcccccaaatcctaagttaactttatagtactttacctaataacgtccggtacccttcgaaggttcgtaactacgttaactcgtcttacacgttcggacctaccgtaacgtcgtacgggtaccaaacgtacccggtcccttacccgtacgtaaccccgtagttcccgttaccgggttacgggacccttacccggaacgggtaaccgaagggtaacgggacggtaacgggcgtaacgtacttacgttacgcggtccgtacgtaccgtcgggacgtattccgaccgttaccctttaggtccgttacggttcggacgttgaacgtaaccgacttaccggtaccgttactacggactaaccggacccgaacgtaccccgtaacccnggttaccgtacctacctcccgttcccgtacccttaccccg

SEQ ID NO: 17992 - DNA, 738 bp, Homo sapiens
  misc_feature: GYAE6OF02HYZA0.13.81.H04.1.454.CMB.1.raw
  modified_base (204)..(204): a, c, t, g, unknown or other
  misc_feature (204)..(204): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttcctcctggagcgtcagccagtctcacctgcaccttgcncaggtgcaacctaagttgttcggtccctatgactagttatattcggtaccgacagaacgccgaggtacgtcctccctagtttacctctggtacggttacaggtacaaacctcaagaataaaccggacgacgggtctcgtcgggaccgtccccgacgtccggtcctttcctcgttcggactaccgaaggtatacgtacgttacccgaccgacgacgtaacggggtacttaacttaccgtactactacgttccgttcgggtaccccgttacctaggttccgtagtacggtacgtacgggaacggttccacgttaacgtttatttaaccgttcggtttacgtccgttacggaccaaccgaaccgtaccgtacgtaccggtacgtttcccgtaccggtaaccggtaccggtacccgtaccggttaccccgtaccggtaccccgttaccgggttaccgaaccgtaacccccggaaccggacccccgtaaacccccgtcggttaccctacccgttacccgttacccgtttaccccccggg

SEQ ID NO: 17993 - DNA, 525 bp, Homo sapiens
  misc_feature: GYAE6OF02GBPQP.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggattccccagccgcttctctggactccgaaggatgacttccgaccaacgcagggatagttactcatctctgggcctcagttctgacgagtgaggctggactattactgtttgacttggcacaacaaccgctgatctcggactgggaccacggtcaccggtctaggtccacgcccgaacggcccaaccccgactcgtccactccttcccg

SEQ ID NO: 17994 - DNA, 646 bp, Homo sapiens
  misc_feature: GYAE6OF02I4X02.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgaagggacgtcccctcccctagtttcctccgtgtaggttcacggttacaaaaccgtcaagaattaaaaccggacgaacggggtctcgtaggtaccgtccccgagtccccgtcttctcgtaggactaccgaaaggtctagtacttccgaccaaacggcgaagggtaacttaattacctacgtacttccgtacgtcgggacctccgtagtcgtagaccgagttacggacggtctgtaacctttatttccgttaggttttcgacgttgactaaccgaactaaccgccgtaggtacttaccgtcggtacctacggacctcgggacctaccgttcgacggtcaaccgtaccccgtaacggaccctaaccccgtctacgtcctaccgtccgttacccg

SEQ ID NO: 17995 - DNA, 744 bp, Homo sapiens
  misc_feature: GYAE6OF02IS7G4.13.81.H04.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
  modified_base (423)..(423): a, c, t, g, unknown or other
  misc_feature (423)..(423): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttcctccgtggcgcgtcagtccagtcncacctgcaccgttgcgcagngcaacaattgttcggtaccatcgactatatagtacgaccacagaagccgagggactcccacccgtagtttccnccgtgtacgttcgaacggtacctaaacgtcgaataacgtaaaccacgacggtactacgtcgaccttccccgagtcccgtactcgtactacggactaaccggaaggtacgtacgttaccttacccggaaccgtaaaccgngggtaacggtaattaaccgttaacgtacgtaactcccgttggttaccgggtaccctaacgtacgtcgttacggaacgtaggtacgacgtacgttcggtaaacttacgtttaacttcggggtttaactacggttacggcctaaaaccctaaaccggtaaccgcccgggttacgtaccggttaccgttacccggggtaaacgtaccggggttaacccaccgtacccgttaaccggttcccggttaaaggcccggaaccgaccccggttaaccggtaacccccaaaccggtccgttacgaccggtttacccacgttttaccccg

SEQ ID NO: 17996 - DNA, 863 bp, Homo sapiens
  misc_feature: GYAE6OF02HLCLZ.13.81.H04.1.454.CMB.1.raw
tcagtcacgtactacacgaccggtgctcgatttagtagtgtagattcgcggggggggtctcaggaggcagcgctctcgggacgtctccaccatggcctgggctctgctattcctcaccctcctcactcaggcatagggtcctgggcccagtctgccctgactcagcctgcctccgtgtctgggtctcctggacagtcgatccaccatcctcctgcactgggaccagcagtgacggttcgtggtacaaagtctatcgtcttcctaggtaacccaaccaaccaaccccgacggaccaaccggaccccccctaaaactctaaacttaaattttacgtagttaattttaccgtaacttaaccgtccggtacccctaccggtaaggttcgttaacttacttaaacgttccgtaccttacctacgttaccggtccttaacccgtaaacggttccgtacggtaaccgaaaccgtacccgggtcccctaccccgttacgaacccgtacttccggtttaccggtccgggtccctaccggtacggaccggtaaagggaaacgggtacccggtaagggtacgttaaccgtttaacgttttaaccgttacccggttccgggttacccggtaccgtttcccggttaacgggtaccgtttaacgttacccgttacccgtttaaacccgttttcgttaaccgggtttaccgtttaccggggtttaaccgttacggttaaccgtaaacccggtaacccggttacccgtaccgggttacccgtaccggtacgtaacccggtacccggtaaaccccggcccctaaacccgtaccgttccgtaacccgtacgtttcccgttacccgtcccccgtttaccccg

SEQ ID NO: 17997 - DNA, 368 bp, Homo sapiens
  misc_feature: GYAE6OF02IWQZ6.13.81.H04.1.454.CMB.1.raw
  modified_base (314)..(314): a, c, t, g, unknown or other
  misc_feature (314)..(314): n is a, c, g, or t
  modified_base (316)..(317): a, c, t, g, unknown or other
  misc_feature (316)..(317): n is a, c, g, or t
  modified_base (320)..(368): a, c, t, g, unknown or other
  misc_feature (320)..(368): n is a, c, g, or t
tcagtcacgtactacacgaccggtgctcgatttagtagtgtagattcgcgggactctggggtcccagacagattcagcggcagtgggtcaggcactgatttcacactgcaaatcagcagggtggaggctgaagatgttgggattttattattgcatgcaaggtgcactctggtctatgtggacgttcggccaagggacaaggtggaaaactcaaaacgaactgtggctgacactatctgttctcactccttccccgcatctgatagtcgtgaacctgacgggcggtcgtggcaacggggtcacgtaagtaggancnncgnnnnnnnnnnnnnnnnnnnnnnnnnnnnnnnnnnnnnnnnnnnnnnnnn

SEQ ID NO: 17998 - DNA, 696 bp, Homo sapiens
  misc_feature: GYAE6OF02HOMN0.13.81.H04.1.454.CMB.1.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagtcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcctaccttgcgcagtggcacctaatgttcggtccctatgactatatagttcggtaccacaaggaacgccgagggctccctcccgtatttcncctgacgttanacggtacaaacgtcaagaactaaacgcgacggctcgtaggaccgtcccaggtcccgtcttccgtcgtggactaccgaaaggtactacggtaacgttcccgacgaaaccggtcgaagggtattaacttaacgtactaactcgtacgtcgggtacctccgaacgttcgttacggaacgtgtacggagtaccgttagtaacttacgtttaacttggtttacgacgtttaggacccttaaagaaccgtaaccgtcgtaggttaccgttaccgttacgggaaccgttccgggaacccgtaccggttaccgtacccggttcggtaaccgggttaaccgaccggtaaccccgaaccggtacccctaaaccccgtacgttcccgtaacctacccgttcgttaccccgg

SEQ ID NO: 17999 - DNA, 387 bp, Homo sapiens
  misc_feature: GYAE6OF02IDH95.13.81.H04.1.454.CMB.1.raw
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
  modified_base (323)..(325): a, c, t, g, unknown or other
  misc_feature (323)..(325): n is a, c, g, or t
  modified_base (327)..(327): a, c, t, g, unknown or other
  misc_feature (327)..(327): n is a, c, g, or t
  modified_base (329)..(334): a, c, t, g, unknown or other
  misc_feature (329)..(334): n is a, c, g, or t
  modified_base (336)..(387): a, c, t, g, unknown or other
  misc_feature (336)..(387): n is a, c, g, or t
tcagtcacgtactacacgaccggtgctcgatttagtagtgtagattcgcggggccactgacatcccagacaggttcagtggcagtgggtctgggacagacttcactctcaccatcagcacactggagcctgaagtatttttgcagtgtattactgtcagcagtatggtanctcacctcggagttcggcaagggaccaaggtgaancaaacgaactgtggctgcgtacatctgtcttacacttccttccgactacgtcctaggtaacttaccgtacgttgaccttggacggccggggtactgggacctagggcgctagttacgnnngntnnnnnntnnnnnnnnnnnnnnnnnnnnnnnnnnnnnnnnnnnnnnnnnnnnnnnnnnnn

SEQ ID NO: 18000 - DNA, 843 bp, Homo sapiens
  misc_feature: GYAE6OF02GX22K.13.81.H04.1.454.CMB.1.raw
tcagtcacgtactacacgaccggtgctcgatttagtagtgtagattcgcgggggtaagaggttgtgtccaccatggcctggactcctctcctcctcctgctcctctctcactgcacacggttccctctcgcaggctgtgctgactcacgccgttccttccctctctgtccttcctccgtggacgcgtcacgtccagttcctaccaccgttcgacctaccgttcggccgtacgtaacggtcggacctaaccgtagtttcggttaccggttacccttagtacgtaacttagttaacgttacgtttaccgggtaacccgaagtaacgggaaccgtacccggaacggggttcccgttacccccccttaccccgttaacggtttttcccctaccggttacggttacggtttaccgaacggttaacctaaaccgttgaacggtaaaacgttaaaaccggcggtaacgggtccttacggtaccggaacccgttccccgaggttaccccgtcctttcggacgtaccgtacgtaccgaaagggtctaccgtaccgtccgaaccggaacgtacggtaaggttaccttacgttactacgtaacgtttccgtaccggtacgggttcctaccgtacggtcgtacggtacgtagtacggacgtcgttaagtaccgtttaagttcgttacgttcgtacgtcgacgaaaccgtacgtaccgtcgtacgtaccgttaccggtacccgtaccggtacggtacccgtaccgtccgtaacccggttcgtaacgcccgtaaccggacccgttaacccgaccccttaccgtaccgtccgtaacccgttccgtacccgttaccccg

SEQ ID NO: 18001 - DNA, 562 bp, Homo sapiens
  misc_feature: GYAE6OF01A5J5R.22.59.F04.1.454.CMB.1.raw
  modified_base (211)..(211): a, c, t, g, unknown or other
  misc_feature (211)..(211): n is a, c, g, or t
  modified_base (275)..(275): a, c, t, g, unknown or other
  misc_feature (275)..(275): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
  modified_base (546)..(546): a, c, t, g, unknown or other
  misc_feature (546)..(546): n is a, c, g, or t
tcagacatacgcgtcacgaccggtgctcgatttagtacacacacttagggtagttgggggaggaactgctcagttaggacccagacggaaccatggaagccccagcgcagcttctcttcctcctgctactctggctcccagtataccactcggacgaaatagtgtatgtacgcagtctccagccaccctcgtctgtgtctccaggggaaanagccaccctctcctgcagggccagtcagagtgttagcaactacgttagtctggtaccagcaagngacctggccacggctcccaggctccgtcagtctatggtcacttcgtaccagggccactggtacctccccgcaggttcagtcgccaggtgggtctgggacagtacgttcactctcaccatcancacgcctgcagtctgaatntttgcttatttattactgtacagtactaattagtaattggtaccgttcgggttacctcgtacgttccgtaccgttaccggaccgaacgggaccacgacgtacggaagtacgttaaacgactgacgtaccncgacctactgtctacg

SEQ ID NO: 18002 - DNA, 781 bp, Homo sapiens
  misc_feature: GYAE6OF01A1PES.22.59.F04.1.454.CMB.1.raw
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtatccgaggggaaagngccacactctcctgcagggccagtcagagtgtagcagcagcttagcctggtaccagcagaaacctggccaggcctcccgaggcctccctcacttctagtggtcnctacgtccgtacggacgggcccaacgttcggtaacctcccccgaggtcccgtaagggtttccaacgggtttcgggaccgtagggttcggggttaccgtcggggaacctaggtacggttttccaccgttacccgtacctaacccacgttccgaacggtacccaacggtcccgtcggaccgtaacgttaccgttaggtaaacgtttacgtttttacggtacgtttaacggtttttaacgtttaaccgtttcgttaaccgttaacggtaacccttaacctttaaacgttaaaaccgttaaccgttacccgggttacccgtttacccggttaaaccgtttacgggtttttacccgggtaacccgggtaacgggggtaacccgtaacgggttaccggttaacggggtaacggtaaccgttaaaccggtaaaaccgggtaaccgttacgggttaccgggtaccggtaaccgg

SEQ ID NO: 18003 - DNA, 498 bp, Homo sapiens
  misc_feature: GYAE6OF01DT79Q.22.59.F04.1.454.CMB.1.raw
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggctcctcatctatggtncatctacgagggccactggtatcccgagccaggttcagtggcagtgggtctgggacagagttcacgtctcacatcagcagcctgcagtctgtaagtattttgctagtttattacgtgtcagctatataatactggcctccgtatagtttgacgtacgggacaaggcgtaggagactacgaagatgtgctcg

SEQ ID NO: 18004 - DNA, 606 bp, Homo sapiens
  misc_feature: GYAE6OF01DER3H.22.59.F04.1.454.CMB.1.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctccgaggggaaangccacactctcctgcagggccagtcagagtgtagcagcagcttagcctggtaccagcagaacctggccaggcctcccgaggcctcctcattctagtggtnactagtcgtacggacggccacgtggtactccccgagtcccgtagggttccaggttcggctaagggttcggggtcctggggaactaggtacgtttccacgtctaccaccgtatccagcacgccgtgctagtcgtagtaagtatttgtcgttaagtttagttacttagtactacgtactaacgttaataacttaacgtcggtacccgttaccgttacgtacggtttcggaccggtaacgggtaccgtaaggtcgtaggtaacgtaacgtaacgaaacgtaagttacggtggcgtacg

SEQ ID NO: 18005 - DNA, 593 bp, Homo sapiens
  misc_feature: GYAE6OF01CMWT3.22.59.F04.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
tcagacatacgcgtcacgaccggtgctcgatttagtacacacacttagggagtttgggggaggaactgcctcgagtttacggacccagacggtaaccatggaagccccagcgcagcttctcttcctcctgctactctggctccagtttcagataccactggagtaaattagtgatgacgtacagtctcagccaccctgtctgtgtctccgagggggaaagngtccacactctccgtgccagggccagtcagagtgtagcagcagcttagcctggtaccagcagaacctggaccaggcctcccaggcctccgtcgatcgtatggtncatctacgaggccagtggtactcccagcctaggttcagtcggcaggtgggtctgggacagtacgttcactctcaccatcagcagcctgcagtctagaagtatttagactagtttaattactgtacagtctaacttaataactaacgttcggtaccttaccgtaacgttaggttttgggtacccggtacgggggtaaccctaagggtccgttacgggaacggtacgttaaccgtaaaaccggtaacggttacgggtcggtaccgtacgg

SEQ ID NO: 18006 - DNA, 503 bp, Homo sapiens
  misc_feature: GYAE6OF01EUKLS.22.59.F04.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
  modified_base (401)..(401): a, c, t, g, unknown or other
  misc_feature (401)..(401): n is a, c, g, or t
  modified_base (482)..(482): a, c, t, g, unknown or other
  misc_feature (482)..(482): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccanactctcctgcagggccagtcagagtgttagcagcagcttagcctggtaccagcagaaacctggccaggctcccaggctcctcatctatggtncatctacgaggccactggtatcccagccaggttcagtggcagtgggtctgggacagtagttcactctcaccatcagcagcctgcagtctgaagtntttgctagtttatactgtacagtctaatataataactggacctcgtactagtttggaccgtacgggaccaaggtctagganacgtacaaacgatggtgctcg

SEQ ID NO: 18007 - DNA, 508 bp, Homo sapiens
  misc_feature: GYAE6OF01BS39Z.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggcctcctcatctatggtgcatctacgagggccactggtactcccagccaggttcagtggcagtgggtctgggacaggagttcactctcaccatcagcagcctgcagtctagaagtatttgctagtttattactgtcagctactataatactgcctcgtactagtttggaccgtagggtaccaaggtcgtaggagactacaaacgaactggtggcgtacg

SEQ ID NO: 18008 - DNA, 505 bp, Homo sapiens
  misc_feature: GYAE6OF01CC9VQ.22.59.F04.1.454.CMB.1.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (501)..(501): a, c, t, g, unknown or other
  misc_feature (501)..(501): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaacctggccaggctcccaggctcctcatctatggtncatctacgaggccacgtggtactcccagccaggttcagtcggctaggtgggtctggggacaggtagttcactctcacatcagcagctcgcagtctagtaagtatttgactagtttattactgtacagctactataatactgtcctcgtactagtttgacgtacgggacaggtcgtaggagactacaacgatgtgntacg

SEQ ID NO: 18009 - DNA, 536 bp, Homo sapiens
  misc_feature: GYAE6OF01CSVO2.22.59.F04.1.454.CMB.1.raw
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctcccaggctcctcatctatggtncatctacgagggccactggtactcccgagccaggttcagtggcaggtgggtctgggacagagttcactctcaccatcagcagcctgcagtctgaagtntttgctagtttattactgtactacgtactacttataactaacgtcggtacctccgttacgtacggttttcggaccgtaggggacccaaggtcgtacgggagtacgtaacgaaacggtatcggtggtcgtacg

SEQ ID NO: 18010 - DNA, 528 bp, Homo sapiens
  misc_feature: GYAE6OF01BWV50.22.59.F04.1.454.CMB.1.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggcctcccaggcctcctcatctagtggtncatctacggagggcctagtggtactcccgagccaggttcaggtggcaggtgggtctgggacagngttcactctcaccatcagcacgcctgcagtctagaagtatttcgacttagtttattactgtacagtctactaataactacgtcgtcctcgttactagtttcggaccgtacggggtacaggtcgtaggagacgtacgaaacgtatggtcggcgtacg

SEQ ID NO: 18011 - DNA, 536 bp, Homo sapiens
  misc_feature: GYAE6OF01CHPPO.22.59.F04.1.454.CMB.1.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggctcccaggctcctcatctatggtncatctacgaggccactggtactccagccaggttcagtgcaggtgggtctgggacaggtagttcactctcacctatcacgcagcctgcagtctagaagtatttgcttagtttattactgtactagtactactactaataacgtcgtacctaccgtacgtacgtttacggaccgtaacgggactacgtacgtaggaagtaacgttaaacgtaacgtaggtcggtcgtgtaccg

SEQ ID NO: 18012 - DNA, 556 bp, Homo sapiens
  misc_feature: GYAE6OF01DOS5P.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgtagcagcagcttagcctggtaccagcagaaacctggccaggctcccaggcctcctcatctatggtgcatctacgaggccacgtggtactcccagccaggttcagtggcaggtgggtctgggacagtagttcactctcaccatcagcagcctgcagtctagtagtatttgtactagtttattacgtgtacagtactactaattaactaacgtcgtaccgttaccgttacgtaggttttcggaccggtacggggaacccgtaaggtcgtacgggtacgaacgtaacgaaaaccggtaacgttacggtggtcgtacgg

SEQ ID NO: 18013 - DNA, 557 bp, Homo sapiens
  misc_feature: GYAE6OF01B2J2R.22.59.F04.1.454.CMB.1.raw
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtcgtctccgagggggaaangccacactctcctgcagggccagtcagagtgttagcagcagcttagcctggtaccagcagaacctggccaggctcccgagctcctcatctatggtcacatcgtacgaggccacgtggtactcccgagccaggttcagtcggcaggttgggtctgggacaggacgttcacgtctcgacactcagcacgctgctagtctagaagtacgttttgacttagtttacttactgtactacgtactaacttaataacgttaacgtacggtccttaccgtactacggtttacggaccgtacggggtacacggtcgtaggagtacgtacgtaaacgtaacgtcggtggcgtacg

SEQ ID NO: 18014 - DNA, 522 bp, Homo sapiens
  misc_feature: GYAE6OF01D7FES.22.59.F04.1.454.CMB.1.raw
  modified_base (210)..(210): a, c, t, g, unknown or other
  misc_feature (210)..(210): n is a, c, g, or t
  modified_base (418)..(418): a, c, t, g, unknown or other
  misc_feature (418)..(418): n is a, c, g, or t
  modified_base (496)..(496): a, c, t, g, unknown or other
  misc_feature (496)..(496): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgtagcagcagcttagcctggtaccagcagaacctggccaggcctcccgaggcctcctcatctagtggtgcatctacggacgggccagtggtactcccgagcctaggttcaggtggctaggtgggtctgggacaggtagttcactctcaccatcagcagcctgctagtctagtaagtntttcgcttagtttattactgtcagtactattatatactcgtcctcgtactacgttggcgtacgggacaggcgtagganacgtacgaaacgtacgtgtgcgtacg

SEQ ID NO: 18015 - DNA, 579 bp, Homo sapiens
  misc_feature: GYAE6OF01BL73P.22.59.F04.1.454.CMB.1.raw
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (384)..(384): a, c, t, g, unknown or other
  misc_feature (384)..(384): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcaggccagtcagagtgtagcagcagcttagcctgaccagcagaactgcaggctccagctctnatcatgtnctatctacgaggccagtggtacncccagccaggttcagtggcaggtgggtctgggacaggagttcactctcacatcacgcgacgccgtcncggggggtactacgtagtaagtacgtttcgtacttagttttagtttacgtacgttacgtagtactacgttaacttaacgtaacgttcgtaccgttaccgttaaccgttacggtttacggtaccggtacgggtaccgaacggtaccgtacgggtaacggtacgtaaccgaaacgtaacgttacgtcggtcgtaccg

SEQ ID NO: 18016 - DNA, 536 bp, Homo sapiens
  misc_feature: GYAE6OF01DHDQ0.22.59.F04.1.454.CMB.1.raw
  modified_base (210)..(210): a, c, t, g, unknown or other
  misc_feature (210)..(210): n is a, c, g, or t
  modified_base (415)..(415): a, c, t, g, unknown or other
  misc_feature (415)..(415): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagctagcctggtaccagcagaaacctggccaggctcccaggctcctcatctagtggtgcatcgtacgagggccacgtggtactcccagccaggttcaggtcggcaggtgggtcgtgggactaggtagttcactctacaccatcgagcagccctgcagtctagaagtnttttgctagtttatacgttgtacagctaacttaataatactgacccttcgtacttacggttggaccgtaggggaccaggtccgttagggataagtaccgaaacgtaacgtggtggcgtacg

SEQ ID NO: 18017 - DNA, 526 bp, Homo sapiens
  misc_feature: GYAE6OF01CSIEK.22.59.F04.1.454.CMB.1.raw
  modified_base (209)..(209): a, c, t, g, unknown or other
  misc_feature (209)..(209): n is a, c, g, or t
  modified_base (316)..(316): a, c, t, g, unknown or other
  misc_feature (316)..(316): n is a, c, g, or t
  modified_base (439)..(439): a, c, t, g, unknown or other
  misc_feature (439)..(439): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctcccaggcctcctcatctatggtgcatctacgngggccactggtactcccagcctaggttcagtgcagtgggtctgggacaggagtcgactcgtcaccatcagcagcctagacgcctagaagtatttgctacgtttattactgtcagcagtcgtancaactccctactacggttccggacggacgggaccgaagggttggagtaacgtacgaaacggtaactcggtaggctcgccgacctacg

SEQ ID NO: 18018 - DNA, 527 bp, Homo sapiens
  misc_feature: GYAE6OF01A95DG.22.59.F04.1.454.CMB.1.raw
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggaccagcagaacctggccaggcctcccaggcctcctcatctatggtncatctacggnggccacgtggtactcccagccaggttcagtcggcaggtggggtctggggacaggacgttcactctcaccatcagcagcctgcagtcgtagtaagtatttgtcttagtttattacgtgtacagctagtacgtacgacggtcggtccgtccgtacgtttcggccggtacggggccgaggcgtggagacacgacgacgacgtcggtggcgtcg

SEQ ID NO: 18019 - DNA, 568 bp, Homo sapiens
  misc_feature: GYAE6OF01AO2F0.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccaggggaaanagccacactctcctgcagggccagtcagagtgttagcagcagcttagcctggtaccagcagaaacctggccaggctcccgaggcctcctcatctatgtgcatccagcagggccactcggtaccccagccctaggttcaggtggcaggtcgggtctgggacaggacgttcactctcacatcagcagcctgcagtctagtaagttatttgcttagtttattactgtacagtctaagttacttaagttacgtacggtccgttacgggtaccgttaccgggaacccgtaacgggtaaccgtagggtacgggtaacgtacgtaaaacggtacgtcggtacgggaccgttacgccgtaactacg

SEQ ID NO: 18020 - DNA, 587 bp, Homo sapiens
  misc_feature: GYAE6OF01CA0AY.22.59.F04.1.454.CMB.1.raw
  modified_base (210)..(210): a, c, t, g, unknown or other
  misc_feature (210)..(210): n is a, c, g, or t
  modified_base (311)..(311): a, c, t, g, unknown or other
  misc_feature (311)..(311): n is a, c, g, or t
tcagacatacgcgtcacgaccggtgctcgatttagtacacacacttagggagttggggggaggaactgctcagttaggacccagacggaaccatggaagccccagcgcagcttctcttcctcctgctactctggctccagtttcagataccactggagaaatagtgatgacgcagtctccagccaccctgtctgtgtcctcgaggggaancgccacactctcctgcagggccagtcagagtgtagcagcagcttagcctggtaccagcaagaacctggccaggcctcccgaggcctcctcatctagtggtnctagtcgtacggacggccagtggtactcccgagtccgtaggttcaggtggctaggtcgggtctgggactaggtacgttcactcctacaccagtacacgcgacgccgtgacgtacgtcgtagtaagttattttcgacttagttttattacgtgtacacgtactaactaattaactacgtacgaccgttaccgtacgttacggtttacggaccggtacgggtaccaaggtcgtacggaacgtacgtaacgtaaacgtaacgtcggtacggtcctacgg

SEQ ID NO: 18021 - DNA, 507 bp, Homo sapiens
  misc_feature: GYAE6OF01A19T9.22.59.F04.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggcctcccaggcctcctcatctatggtncatctacgagggccactggtactcccagccaggttcagtgcagtgggtctgggacagagttcactctcaccatcagcagcctgcagtctgagtatttgctagtttattactgtacagtctactataataactgtcctcgtactacgtttcggccgtacgggacaggtcgtaggagacgtacaaacgagtgtggctacg

SEQ ID NO: 18022 - DNA, 579 bp, Homo sapiens
  misc_feature: GYAE6OF01CKH13.22.59.F04.1.454.CMB.1.raw
  modified_base (313)..(313): a, c, t, g, unknown or other
  misc_feature (313)..(313): n is a, c, g, or t
tcagacatacgcgtcacgaccggtgctcgatttagtacacacacttagggattgggggaggaactgctcagttaggacccagacggaaccatggaagccccagcgcagattctcttcctcctgctactctggctcccagtttcagataccactggagaaatagtgatgacgcagtctccagcccaccctgtctgtgtctccgaggggaaagagccacactctcctgcagggccagtcagagtgtagcagcagcttagcctggtaccagcaagaacctggaccaggcctcccaggcctcctcagtctagtggtncatcgtacggacgggcctaacgtggtactcccgagtccaggttcaggtggctaggtggggtctagggacaggtcgttcactctacacctactcgagcgacgcctgcacgtcgtagtaagtatttagacttagtttattacgtgtactagtactactaattaactacgtcgtaccgtccgttacgttacggtttaggaccggtacggggtaactaacggtacgtagggaacgtaacgtaacgaaacgtagtacggtcggtcgtacgg

SEQ ID NO: 18023 - DNA, 558 bp, Homo sapiens
  misc_feature: GYAE6OF01BSYOS.22.59.F04.1.454.CMB.1.raw
  modified_base (209)..(209): a, c, t, g, unknown or other
  misc_feature (209)..(209): n is a, c, g, or t
  modified_base (416)..(416): a, c, t, g, unknown or other
  misc_feature (416)..(416): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggcctcccaggcctcctcatctatggtgcatctacgagggccacgtggtactcccagcctaggttcaggtggctaggtgggtctgggacaggtacgttcactctcaccatcagcacgtcctgcagtctagaagtntttgcttagtttattacgtgtacagtctagttaattaacttacgtcggtccgttcgggtaccgttccggaccgtaacgggacccgtaaggggtacggtaacggtacgaaacggtacgtggtacggactcggacctacgtacg

SEQ ID NO: 18024 - DNA, 572 bp, Homo sapiens
  misc_feature: GYAE6OF01C0GJX.22.59.F04.1.454.CMB.1.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccagtttcagataccactggagaaatagtgatgacgcagtctccagccaccctgtctgtgtctccgagggggaaangccacactctcctgcagggccagtcagagtgttagcagcagcttagcctggtaccagcaagaacctggccaggctcccgaggcctcctcatctatggtncatcgtacggaggccacgtggtactccagccaggttcagtggcaggtgggtctggggactaggtacgttcgactctaccacctactcacgcacgcctgcgagtctagtaagtagtttgtacttagtttacttacgttcgtacgtagtactaactaataattaacgtcgtacccttacgttacgtacggttttacggaccggtacggggtaaccgaacggtcggtacggaagtacgtaacgaaacgtacgtcggtagtcgtacg

SEQ ID NO: 18025 - DNA, 541 bp, Homo sapiens
  misc_feature: GYAE6OF01CJ8W1.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaacctggccaggctcccaggcctcctcatctatggtgcatctacggacggccacgtggtactcccagcctaggtcaggtcggcaggtgggtctagggacaggtacgttcactctacaccatcagcacgctgcagtcgtagaagtatttgcttagtttattactgtacagtactactaataactaacgtcggtacctaccgttacgtacggtttcggaccgtacggggtaccaggtcgtaggtacgtactaacgaaacgagtggtggcgtacgg

SEQ ID NO: 18026 - DNA, 620 bp, Homo sapiens
  misc_feature: GYAE6OF01DDCLU.22.59.F04.1.454.CMB.1.raw
  modified_base (212)..(212): a, c, t, g, unknown or other
  misc_feature (212)..(212): n is a, c, g, or t
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagccaccctgtctgtgtctccgaaggggaaancgccacactctcctgcgagggccagtcagagtgtagcagcagtcttagcctaggtacagcaacgaacctggccaggcctacccgaggcctctcatctagtggtnactatcgtaggacggcctacgtggtactcccgagaccgtaggttcaggtggcgtaggtgggtcnggganagtacgtcactccacaccgtactacgacgcacgcctgactacgtacgtagtaacgttnttttacggctttaaggtttacttacgttcgttacgacgtaacctaacttaagttaacgttaacgtcgggtaacccttaccggtaacgtttacgggtttcggaccggtaacggggtacctaacggtcgtaagggaacttaacgtaaccgaaacgtaacgttgggtaccgtcgtaaccg

SEQ ID NO: 18027 - DNA, 568 bp, Homo sapiens
  misc_feature: GYAE6OF01EAWEL.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagctagcctggtaccagcagaaacctggccaggcctcccgaggcctcctcatctatggtgctatctacggcggccacgtggtactcccgagcccgtaggttcaggtggcgtaggtggggtctgggacaggtacttcactctccaccatcacgcacgcctgctagtctagaagtatttgacttagtttacttacgtgtacagtactaacttaactaattaacgtcggtacccttaccgttacgttacggtttacgggacccgtacggggtaaccaggtcgtagggaagaacgtaccgaaacgtacgttggtcggcgtacg

SEQ ID NO: 18028 - DNA, 551 bp, Homo sapiens
  misc_feature: GYAE6OF01ELJ19.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcaagaaacctggccaggcctcccgaggcctcctcatctatggtgcatctacggagggccacgtggtactcccgagcccgtaggttcaggtggctaggtcggggtctggggacaggagttcactctcaccatcagcagcctgcagtctagtaagtatttgcttagtttattactgtacagtctaacttattaataacgtcggtacctcgtacgtaggtttcggaccgtacggggtaccaggtcgtaggtacgaacgtacgaaacgtaacgtcggtggtcgtacgg

SEQ ID NO: 18029 - DNA, 683 bp, Homo sapiens
  misc_feature: GYAE6OF01BUIO8.22.59.F04.1.454.CMB.1.raw
tcagacatacgcgtcacgaccggtgctcgattttagtacacacacttagggtagtttgggggaggaactgctcgagttaggtacccacgacggaaccactagggaacgtccccagtcggcagcttctcttcctcctgctactctggctcccagtttcagattaccgactggagaaataggttgattgacgctagtctccagccaccctgtctgtgtctaccaggggaaagagccacgactctccgtcgcacgggccgtacgtcagagttgttacgcgaggcagcttagccgtaggtaccagtcaagaaaccttggccaggcctcccgagggcctcctactactccgtaaggtgggtcacgagttccgtacggacggacctagttcggtaacgtcccgaggtaccgtaaggttacaggtcggactaggttcgggtcgtaggggacgtaggtacgtttccaccttactccacccaagtacgaacgaccgaacgtaccgtacgaccgtacgttacctagtaacgttacttttagacgttagttttacttacgtacgttaccacggactaacgttaattaacgttacgttcggtaccttacgttacgttacggtttacgggaccgtaacggggtacctaggtccgtaggtaacgttacgtacgaaacgtacgtggtacgtcgtaacg

SEQ ID NO: 18030 - DNA, 557 bp, Homo sapiens
  misc_feature: GYAE6OF01AZ8HS.22.59.F04.1.454.CMB.1.raw
  modified_base (370)..(370): a, c, t, g, unknown or other
  misc_feature (370)..(370): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcggataccactggagaaatagtgatgacgcagtctccagccaccctgtctgtgtctccaggggaaagagccacactctcctgcagggccagtcagagtgttagcagcagcttagcctggtaccagcagaacctggccaggctcccaggctcctcatctatggtgcatctacggagggcccacgtggtactcccgagccgaggttcaggtggcaggtgggtctgggacngtagttcactctcaccatcagcagcctgcagtctagaagtattttgctagttttattacttgtcagtctaacttaattaattaacgtcggtcccttacccgttacgttacggtttcggaccggtaacggggtacccaaggtcgtagggagtagtaccgtaaacgtacgttaggtacggtcgtggacc

SEQ ID NO: 18031 - DNA, 609 bp, Homo sapiens
  misc_feature: GYAE6OF01AONE5.22.59.F04.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctcctgcagggccagtcagagtgttagcagcagcttagcctggtaccagcagaacctggccaggcctcccgaggcctccgtcatctatggtncatctacggaggccagtggtactcccgagccaggttcagtcggctaggtcgggtctgggactaggtagttcactctcaccatcgagcacgcctgactagtcgtagtaacgtatttcgacttagtttacttacgttcgtactacgtacctaacttaattaaacttaaccgttcggtacccgttaccggtacgtttacgggttttaccgggaccggtaaccggggtaaccgtaacggttccgtaagggtaacgtaacgttaaaccgtaaaacggtaaccgttacggtcgggtccgttaccgg

SEQ ID NO: 18032 - DNA, 592 bp, Homo sapiens
  misc_feature: GYAE6OF01A5IE5.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagngccacactctcctgcagggccagtcagagtgttagcagcagcttagcctggtaccagcagaaacctggccaggcctcccgaggcctccgtcatctatggtgcatctacggagggccacgtcggtactcccgagccgtaggttcaggtcggcaggttggggtctgggactaggtacgttccacttctccgaccatccagcacgcctgctagtcgtagaacgtagttttgacttagttttacttacttcgtacgagtacgtaacttaattaaattaacgtacggtacccttaccggttacgttaggttttacgggaccggtacgggtaacccgaaggtcgtagggtaagaacgtaaccgaaacggtaactggtcggtcgtacgg

SEQ ID NO: 18033 - DNA, 608 bp, Homo sapiens
  misc_feature: GYAE6OF01DZGIM.22.59.F04.1.454.CMB.1.raw
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaagggggaaanagccacactctcctgcagggccagtcagagtgttagcagcagcttagcctggtaccagcagaacctggccaggcctcccgaggcctccgtcatctagtggtgctatcgtacggacgggcctacgtcggtactcccgaggtccctaggttcaggttggctaggtggggtctaggggactaggtacgttccactctaccaccatcagcacgtcctgcagtctagtaagtagttttgacttagttttacttacttgtacagtacctaattaacttaaacgtacgtcggtcccttaccggttaccgttaggtttacggaccggtaacggggtacctaaggtcgttaacgggtaacgtaacgtaaccgtaaaacggtaacgttcgggtcggtccgtaccgg

SEQ ID NO: 18034 - DNA, 574 bp, Homo sapiens
  misc_feature: GYAE6OF01BGW7Q.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagccagaaacctggccaggcctcccaggcctcctcatctagtggtgcatctaacgacggccacgtggtactccccgagccgtaggttcaggtggccgtaggtcgggtcgtagggacaggtacgttacactctccaccatcacgtccagcctagctacgtcgtagtaagtagtttcgacttagtttattacgtgtactagtactaacttaagttaactaacgtcgtacccttaccgtacgttacggtttcggaccgtacgggtaaccaacggtcgtaggtagtaacgtacgaaacggtatggtcgcgtacg

SEQ ID NO: 18035 - DNA, 670 bp, Homo sapiens
  misc_feature: GYAE6OF01DWA22.22.59.F04.1.454.CMB.1.raw
  modified_base (210)..(210): a, c, t, g, unknown or other
  misc_feature (210)..(210): n is a, c, g, or t
  modified_base (323)..(323): a, c, t, g, unknown or other
  misc_feature (323)..(323): n is a, c, g, or t
  modified_base (444)..(444): a, c, t, g, unknown or other
  misc_feature (444)..(444): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttaaactactacttagccctggtaaccaacagaaacctggccaggcctcccgaggcctcctcatctatgatgcatcttacnggccagtgcatcccaagcgtagtcgaggtcgagtagggtcggtcggagggacacgttactccgacttcccacacctacacgacgtacaccgtacgtaacgcgttacgtaaggtaacgtttntttacgtacgtttaattttaacgtagttccgtaacgtacgtacgtaacggttaccgtaacccgtaccgttaacccctttcccgtaccgggttaccgggttacccggggaaacggggtaacccgggtaaaccggttaggggacggtaaacgtaacggtaaaaccggtaaaccgtacggttcggttacggacccgttcgaacccgttaacgtcgttcccggttttacc

SEQ ID NO: 18036 - DNA, 536 bp, Homo sapiens
  misc_feature: GYAE6OF01EZSP1.22.59.F04.1.454.CMB.1.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (378)..(378): a, c, t, g, unknown or other
  misc_feature (378)..(378): n is a, c, g, or t
  modified_base (411)..(411): a, c, t, g, unknown or other
  misc_feature (411)..(411): n is a, c, g, or t
tcagacatacgcgtcacgaccggtgctcgatttagtacacacacttagggattgggggaggaactgctcagttaggacccagacggaaccatggagccccagcgcagcttctcttcctcctgctactctggctcccagtttcagataccactggagaaatagtgatgacgcagtctccagccaccctgtctgtgtctccaggggaanagccacactctcctgcagggccagtcagagtgttagcagcagcttagcctggtaccagcagaaacctggccaggctcccaggctcctnatctatggtgcatctacggngggcccacgtggtactcccagcccaggttcagtggcaggtgggtctgggacagagttcactcncaccatcacgcacgcctgccagtctagaacgtnttttgcttagtttattacgtgtcagctaacttataatactggtcctaccgtagttagtttcggccgtaacgggtaccaggtccgtagggaactacgaacctaaacggtaatggtacggtcgtacg

SEQ ID NO: 18037 - DNA, 528 bp, Homo sapiens
  misc_feature: GYAE6OF01B84A8.22.59.F04.1.454.CMB.1.raw
  modified_base (211)..(211): a, c, t, g, unknown or other
  misc_feature (211)..(211): n is a, c, g, or t
  modified_base (321)..(321): a, c, t, g, unknown or other
  misc_feature (321)..(321): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgttagcagcagcttagcctggtaccagcagaacctggccaggcctcccaggcctcctcatcgtatggtgcatcgtacggngggccacgtggtactcccgagcctaggttcaggtggctaggtcgggtctgggacaggagttcactctcacctatcagcacgcctgcgtagtctaggaagttatttgacttagtttattactgtacagtactaatataatacgtcgtccttcgtactgttcggaccgacgggtacaggtcgaggagactacgaacgagtgtgtcgtcg

SEQ ID NO: 18038 - DNA, 549 bp, Homo sapiens
  misc_feature: GYAE6OF01CUCZ3.22.59.F04.1.454.CMB.1.raw
tcagacatacgcgtcacgaccggtgctcgatttagtacacacacttagggattgggggaggaactgctcagttaggacccagacggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtcgtaggaagagacttcactctcaccatcaacagcctagagcctgacgattctgctagtttattactgtcagacacgacgtaccaagtcggcctccgtacgttttcgggccgtacggggcccgaagtcgaggagacgtcaaggacgtaacgttaggtcggctcggtaccaccgtacttcgtgttccttcgtacgttccccg

SEQ ID NO: 18039 - DNA, 678 bp, Homo sapiens
  misc_feature: GYAE6OF01AYWFA.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtatccgaggggaaanagccacactctcctgcagggccagtcagagtgtagcagcagcttagcctggtaccagcaagaaccgtggccaggcctcccgaggcctcctcatctagtggtcgctagtccgtacggacgggtcctacgtcggtacctcccgagccgtaagggttcaggtcggcgtaggttcggggtcgtagggaactaggtacgtttccaccgttccgtaccaccctactaccgacgtccgtaacgtcccgtacgaccgtacggtcgtaacggtaagtttacgttttacgactttaaggttttactttacgtcgttacgtaacgtaccttaacttaaacgttaaacgttaaccgtcggtacccgtttaccgttaacgttaccgggttttacggacccggtaacggggtacctaacgggtccgtacgggaacgtaaccgttaaaccggaaacgtaacgttcgggtacggtccgtaccgg

SEQ ID NO: 18040 - DNA, 717 bp, Homo sapiens
  misc_feature: GYAE6OF01C4ZJ9.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcaggccagtcagagtgtagcagcagctagcctggtaccagcagaacctggccaggcctcccgaggcctcctcatctatggtgctatcgtacggcgggcctacgtggtacctcccgagtcccgtaagggttccaaggttcgggaccgtagggttgggggtccgtagggggaaccagggttacgtttaccgaccttccgttacccgaaccctaacgttaccgaacggacccgaacggtccccgttaggaccgtacggttaccgtagggtaaacgttagtttttacgtacgttaacggttttttactttaacggttcgttaccgaaggttaccctaacgtttaaacttaaacgttaaccgttcggttaaccccgttacccggttaaccgttaaccgggtttttcgggacccggtaacgggggaccctaaggtccggttacgggtaaacgttaacgtaaccgtaaaacggtacgttcgggtacggtcgtaacccgg

SEQ ID NO: 18041 - DNA, 553 bp, Homo sapiens
  misc_feature: GYAE6OF01A9A9V.22.59.F04.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggctccncatctatggtgcatctacgngggccactcggtactcccagccaggttcagtggctaggtgggtctgggacagagttcactcncaccatcagcagcctgcagtctagagtntttgctagtttacttacgtgtacgacgtctaacttactaataaccttcggtcccttaccgttactacggttttcggaccgtaacggggtaaccaaggtccgttagggaacgtaacgtaaccgtaaacggaacgtggtggtctaccgg

SEQ ID NO: 18042 - DNA, 707 bp, Homo sapiens
  misc_feature: GYAE6OF01EBNBK.22.59.F04.1.454.CMB.1.raw
  modified_base (312)..(312): a, c, t, g, unknown or other
  misc_feature (312)..(312): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcaggccagtcagagtgtagcagcagcttagcctggtaccagacaagaaacctggaccaggcctcccaggcctcctcatctagtggtnctagtcgtacggacgggccacgtcggtactccccgagccctaggttcaggtggcctaggtggggtcgtaggggactaaggtacgtttaccaccgttcctaccaaccctagtaccgaacgacctaacggtccccgtggtacctaggttccgtaggtaaacgttagtttttacggtactttaaggtttttaacttacgttaggttaccgtaacggtaccttaaacgtttaaacttaaacgttaaccgttaccggtacccttacccggtttaacgttacgggtttttaccgggacccggtaaaccggggggtaaaccctaacgggtcgttaacggggtaaacgtaaacgttaaaccgaaaaaccggtaacggtttacgggtcgggtaccgtaaccggg

SEQ ID NO: 18043 - DNA, 621 bp, Homo sapiens
  misc_feature: GYAE6OF01A6OZU.22.59.F04.1.454.CMB.1.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctccaggggaangccacactctcctgcagggccagtcagagtgttagcagcagcttagccgtggtaccagcagaacctggccaggctccaggcctccgtcatcctagtcggtnactatcgtacgcggcctagtggtactcccgagtcccaggttcaggttcggctaggtcgggtctgggaccaggtcgttccacgtctacacccgtagtccgacgtccaagtcccgtagaccgtacgtacgtagtaaacgttattttcgacgttaaggttttacttaacgttcgttaacgtacgtaccgttaacgttaacgttaaacgtaacgttccggtacccttaccgtaacgttagggttttccggacccgtaggggtaccctaaggtccgttaggacgtacttacgaaacgtagttcggtacgtcgtacg

SEQ ID NO: 18044 - DNA, 654 bp, Homo sapiens
  misc_feature: GYAE6OF01EO4T3.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagngccacactctcctgcagggccagtcagagtgttagcagcagcttagcctggtaccagcaagaaacctggaccaggcctccgaggcctcctcatctagtggtgctatcgtacggacggccacgttcggtactcccgagtccgtagggttcaggttcggacgtagggttcggggtacgtaggggaccgtaaggtacgtttccacttccgtaccaccgtacgtccgaacggccacggtcccgtcgtaccgtacgtacgttacgtaacgttagttttcggtacgtttaagttttactttacgttcgttactacgtactaacttaattaaacttaacgtacggtaccttaccgttacgttacggttttacggaccggtaacggggtaacctaacggtcggttaggaacgtaacgtaaccgtaaacgtaacgttcggtcggtcgtaccgg

SEQ ID NO: 18045 - DNA, 607 bp, Homo sapiens
  misc_feature: GYAE6OF01C3GG8.22.59.F04.1.454.CMB.1.raw
  modified_base (210)..(210): a, c, t, g, unknown or other
  misc_feature (210)..(210): n is a, c, g, or t
  modified_base (457)..(457): a, c, t, g, unknown or other
  misc_feature (457)..(457): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagatacccatggagaaatagtgatgacgcagtctccagccaccctgtctgtgtctccgaggggaaanacgccacactctctgcagggccagtcagagtgtagcagcagcttagcctaggtacccagacaagaaaccctggacccaggcctcccgaggccttctcattctagtggtgcattcgaacggaggccacgttggaactcccaggtacccgtaggttccaggtcgggacctagggttcgggtacgtggggaactaggtacgttcacgtcgtaccacagtcagcctagccgtgctagtactaggtaacgtnttttgacttagtttattactgtacgtacgtactaagtattaacttcgttcggtccttacggtaccgtacgggtaaccggaacgggtaaccgaagggtaggtaaacggtaaccgaaacggtacgtagggtacgagtcgtaaccgtctaacg

SEQ ID NO: 18046 - DNA, 752 bp, Homo sapiens
  misc_feature: GYAE6OF01CQT3M.22.59.F04.1.454.CMB.1.raw
  modified_base (255)..(255): a, c, t, g, unknown or other
  misc_feature (255)..(255): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctcgaggggaaagagcccacactcctcctgacgacgggacccagtcgagagttggtanccgaagcagtactttagcccgttaggtaaccgagaccgaaacgtaaacccgtcgggccacgggtcctccccgaacgggcccttcccgtacctaacttccgttaagttcgggggttcacctaaccgttaccggtaaacccgggacggggtacccctaacgttgggttaacctcccccgaagtacccgtagggttacaggtcgggacaggggtttcggggtcttagggggaacctagggttaacgttcccaccgttaccttacccgtaacctaccgtacgaacgccctaacggtcctacggacgtaacgtccgttaaggtaaggtttacttttacgtactttaggttttaacttacgtgttacacgtacctaattaacttaacgtaccgtcggtacccttaccggttacgttacggttcgggacccgtaaggggtaacctaacggtcgttagggaacgtaacgtaacggtaaaacgtacggttcgggtcgtccgtaacg

SEQ ID NO: 18047 - DNA, 698 bp, Homo sapiens
  misc_feature: GYAE6OF01DZ1UL.22.59.F04.1.454.CMB.1.raw
  modified_base (211)..(211): a, c, t, g, unknown or other
  misc_feature (211)..(211): n is a, c, g, or t
  modified_base (324)..(324): a, c, t, g, unknown or other
  misc_feature (324)..(324): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagttcagataccactggagaaatagtgatgacgcagtctccagccaccctgtctgtgtctaccgaaggggaaanacgcccacactctcctgcagggccagtcagagtgtagcagcagtcttagccctaggtacccagacaagaaaccctggaccacggcctccgaggcctccgtcatcgtatcggtncctagtccgtacggacggtccctacgttcggaactccccgaggtcccgtaaggttccaagggttcggacgtaggtcgggtaccgtggggtaactaggtacgttaccacgtcctacgaaccctagtccgaacgcctacggccgttaggtaccgtaggtttaccgtaaggttaacgttagtttttacggacgttttaagttttaacgttacgttacgttaccgaacgtacttaaacgttaacgttaaacgtaccgttcgtaaccgttacccgttaacgttcggtttaccgggaccggtaaaccggggttaccaacggtcggtaacggtaagtaacgtacccggtaaaacgaccggtttcgggtacggtccgtaccg

SEQ ID NO: 18048 - DNA, 661 bp, Homo sapiens
  misc_feature: GYAE6OF01DP05N.22.59.F04.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctcctgcagggccagtcagngtgtagcagcagcttagcctggtaccagcagaacctggccaggcctcccaggcctccgtcatctagtggtncatcgtacgacggaccacgtcgtactcccgagccgtaggttcgaggtggcgaggtgggtcgtagggactagtagttccactcgtaccacctatacgacgacgacgtcctagactacgttacgtaggtaacgttagtttacgtacgtttaacgttttactttacgttagttaccgtaagtacctaacttaacgttaaacgttaaccgttaccgggtacccgtttacccggttaacgtttaccgggttttaccgggaacccggtaacgggggtaaacccgtaacgggtccggtaacgggtaacgtaaccgttaaccggtaaaaccggtacggtacggttacggtacgtaacccgg

SEQ ID NO: 18049 - DNA, 551 bp, Homo sapiens
  misc_feature: GYAE6OF01C21BJ.22.59.F04.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
tcagacatacgcgtcacgaccggtgctcgatttagtacacacacttagggatgggggaggaactgctcagttaggacccagacggaaccatggaagccccagcgcagcttctcttcctcctgctactctggctcccagtttcagataccactggagaaatagtgatgacgcagtctccagccaccctgtctgtgtctaccgaggggaaangccacactctcctgcagggccagtcagagtgtagcagcagcttagcctggtaccagcaacgaacctggccaggcctccgaggcctccncatctatggtcncatctacgaggccactggtactcccagccctaggttcagtggacaggtcgggtctgggactaggtacgttcacgtctaccacctatcagctagcctgccagtctagtaagtntttcgcttagtttattactgtactagtactactataactaacgtgtaccctacgttacgtacggtttcggaccgtacggggacctacggtcgtaggtaatacgtaacgaaacgtagtcggtgtcgtacg

SEQ ID NO: 18050 - DNA, 601 bp, Homo sapiens
  misc_feature: GYAE6OF01BHU1G.22.59.F04.1.454.CMB.1.raw
  modified_base (210)..(210): a, c, t, g, unknown or other
  misc_feature (210)..(210): n is a, c, g, or t
  modified_base (353)..(353): a, c, t, g, unknown or other
  misc_feature (353)..(353): n is a, c, g, or t
  modified_base (595)..(595): a, c, t, g, unknown or other
  misc_feature (595)..(595): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactcctctgcagggccaggtcagtagtgttagcagcagtcttacgccgttaggtaccaggccaaggaacctggccgaggcctccgagcctcctgactcgtagtcggcgcactcgtacggacggcctacggtcggtacncccgtagccgtagggttcaggtcggacgtagggtggtcgtaggactaggtgttccactctacactactcgacgtcacggtctgaccgtgtacgtaggtaactttgtttacgtacgttagtttactacgtgtacgacgtactaactaattaactacgtcgtccttaccgtacgttacgtttaccggaccggtaagggtaccacggtcgtaggaacgtacgtaacgaacgtacgtacggtcggntaccgg

SEQ ID NO: 18051 - DNA, 773 bp, Homo sapiens
  misc_feature: GYAE6OF01BXK1O.22.59.F04.1.454.CMB.1.raw
tcagacatacgcgtcacgaccggtgctcgatttagtacacacacttagggagttgggggagaactgcctcagttaggacccagacggaaccatggaagccccagccgcagcttctcttcctcctagctacgtctggcctcccgagtttcacgacttaccacgtggagaaatagtgactgacgcacgtctccagccaccctgtctgtgtctcgagggaaagcgccgacactcgtccagacgacgggccagtcagtagtgtacgcagcagacttacgccgtaggtaccagctaacgaaaccgtcggaccaggcctacccgaggccttaccgtcacgttccgtacgtgggtacgacgtagttccggtaacgggacggggaccctaacggttacggtaactaccccgaacgtaccccgtaaggggttcccgtaagggtcggaccgtaaggggtcgggttccgtaggggaacaacggtacgtttaccgtaaccgttccgtaccgaacccgtacgttaccgaacggaccgtacggtcccgttacgaccggtaacggttaccgtaacggtaacggttacgttttacgaccgtttaagttttaaccgttaacgttcggtaacgtaacgtaaccttaaacgttaaacttaaacgttaaccgtacggtacccgttaccggttaccgttacggttttaccggaccggtaacgggtaacccgaacggtccgtacgggaacgtaacggtaaccgtaaacggtacggttcggtacggccggtaccgg

SEQ ID NO: 18052 - DNA, 585 bp, Homo sapiens
  misc_feature: GYAE6OF01BZVTQ.22.59.F04.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtatccaggggaaangccanactctcctgcagggccagtcagagtgtagcagcagcttagcctggtaccagcagaacctggccaggctcccgaggcctcctcatctatcggtncatcgtacgaggccagtgactcccgagccgaggttcaggtcggactaggttcgggtcgtaggggaacctaggtacgtttcaccttcctccaacctatcgagtccgacgtcctgacgtagtcgtaggtaagttagtttgacgtttagtttactttacgtgttacaagtacttaacttaaattaacgttaacgtccggtaccgttacgttacgttacggtttcgggaccgtacgggtaccaggtcgtagaagtactaaacgaacgtaagtggtgcgtacg

SEQ ID NO: 18053 - DNA, 631 bp, Homo sapiens
  misc_feature: GYAE6OF01CSZ5F.22.59.F04.1.454.CMB.1.raw
  modified_base (212)..(212): a, c, t, g, unknown or other
  misc_feature (212)..(212): n is a, c, g, or t
  modified_base (340)..(340): a, c, t, g, unknown or other
  misc_feature (340)..(340): n is a, c, g, or t
  modified_base (435)..(435): a, c, t, g, unknown or other
  misc_feature (435)..(435): n is a, c, g, or t
  modified_base (530)..(530): a, c, t, g, unknown or other
  misc_feature (530)..(530): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctaccgaaggggaaancgccacactctcctgcgaggccagtcagtagtgtagcagcagtcttagccgtaggtaccagaccaagaacctggacctacgggcctacccgaggtccttaccctacacgttcctaaggtcgggttacncctaacgttcgtaacgggtaccgggcctaaccggtggtaaccctcccgaggtccccgttaagggtccagggtcggacgtagggttcgggttacgngggtaaccaggttacgttacacgtcctaccacctagtacgacgcacgtctacgactacgtacgtagtaagttactttgacttagtttattacgtntacagtactacttaactaatacgtcgtcctacgtacgtcgttacggaccggtacggaactaggtcgtagacgacgtaaccgtaagacgtgtcggtcgtacg

SEQ ID NO: 18054 - DNA, 491 bp, Homo sapiens
  misc_feature: GYAE6OF01CK4S8.22.59.F04.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (356)..(356): a, c, t, g, unknown or other
  misc_feature (356)..(356): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagacatacgcgtcacgaccggtgctcgatttagtacacacacttagggattgggggaggaactgctcagtttaggacccagacggaaccatggaagccccagcgcagcttctacttcctcctgctactctggctcccagtttcagataccactggagaaatagtgatgacgcagtctccagccaccctgtctgtgtctccaggggaangccaccctntcctgcagggccagtcagagtgttaactactacttagcctggtaccaacagaacctggccaggctccaggctcctcatctatcgatgcatctacagggccatgcatcccagccaggttcagtgcagtggtctggacngacttcactctcacatcagcagctagacgcctagaagtatttgctagtttatactgtcagcagcgtagctactcctcgacgttcggcggacggaccaggtgagtactanaacggactgtgctgcaccntcgtgtc

SEQ ID NO: 18055 - DNA, 652 bp, Homo sapiens
  misc_feature: GYAE6OF01B0DBX.22.59.F04.1.454.CMB.1.raw
  modified_base (215)..(215): a, c, t, g, unknown or other
  misc_feature (215)..(215): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggaagaaatagtgatgacgcagtctccagcccaccctgtcctgtcgtctccgaaggggaaangccacactctcctgcacgggccagtcagtagtgtagcagcagcttagcctggaccagcaagaaccgtggccaggctcccgaggcctcctcacttctagtggtcactatcgtaacgggacggtcctacgtggtacctccccgagtcccgtaagggttcagggtcggacgtagggtcggggttcgtaggggactagggtacgttccaccgttccgtaccaccttacgtacgacgtcccgagtccctaggcctaggtctaggtaacgttgtttcgactttacgttttaactacgtcgtactaacggtactaacgttaattaaacttaccgtacggtcccttacggttacgttcgggtttaccggaccggtaaccgggtaaccaggtaccggtacgggtaacgtaacgtaacggtaaacgtacggtggtccggtctaccgg

SEQ ID NO: 18056 - DNA, 567 bp, Homo sapiens
  misc_feature: GYAE6OF01DVW80.22.59.F04.1.454.CMB.1.raw
  modified_base (208)..(208): a, c, t, g, unknown or other
  misc_feature (208)..(208): n is a, c, g, or t
  modified_base (319)..(319): a, c, t, g, unknown or other
  misc_feature (319)..(319): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaanagccacactctcctgcagggccagtcagagtgttagcagcagcttagcctggtacccagcagaaacctggaccaggcctcccaggcctcctcatctatggtgcatctacgnggccagtggtactcccagcccaggttcagtggctaggtggggtctggggacagtagttcactctacacctatcagcacgcctgctagtctagaacgtattttgactagttttacttacgtgtacgtagctaacttaattaacttaaccgtcggtacccttcccgtaacttcggttttacggccggtaacggggtacctacggccgtaggacgtaacgtacgaaaacgacgttacggtggtcgtaccgg

SEQ ID NO: 18057 - DNA, 686 bp, Homo sapiens
  misc_feature: GYAE6OF01BDKM1.22.59.F04.1.454.CMB.1.raw
  modified_base (678)..(678): a, c, t, g, unknown or other
  misc_feature (678)..(678): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctttgtctccaggagagcgggccaccctctcctgcagggccaatgagagtatagcgactactagcctggtaccaacagacggctggccaggctcccgaggcctcctcactgtatgatgccttaccgaaaaggcccacgtcggacactacccagtccgacggttcaaggtcggacgtagggtcgggtccttagggaagtacgtactttacgaccttcctaccacctaacgtaccaaacgtacgtacctaacggacgtacccgtaggtaaccgtacgtttaccgtagtaccgttaacgtttttaatttaccgttaggttaccaggtacgacggtaacccgtaaccgtaacgggttccggtaccttaccccgtttacggttttaccgggacccgggtaaccggggggtacctaaacggtcggttacgggtaacgtagtacccggaaacgggtaccggtaacgtcgggtacggtacgtacgacctaaccgtnttacccgg

SEQ ID NO: 18058 - DNA, 703 bp, Homo sapiens
  misc_feature: GYAE6OF01DCDEU.22.59.F04.1.454.CMB.1.raw
  modified_base (157)..(157): a, c, t, g, unknown or other
  misc_feature (157)..(157): n is a, c, g, or t
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (434)..(434): a, c, t, g, unknown or other
  misc_feature (434)..(434): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactgganaaatagtgatgacgcagtctcagccaccctgtctgtgtctccgaaggggaaangccacactctcctgcgagggccagtcagagtgttagcagcagctanccgtggtaccagacacgaacctggaccaggcctccgaggtcctcctcattctagtcggtcgactacgtcgaacggcggccctagtcggtacctcccgagtaccgtaggtttcgaggtcggaccgtagggttcgggtcgtacgggactaggtacggttctaacctcgtaccgacctaancgacgtcacgccgtcgacgtacgtctaaggtaacgtttacgttttacgtagtttaacgttttgttaaccgttgttaccgtaagttacctaaacgttaacttaaacgttaaccgttccgggtaccgttacccggtttaacggtaccgggttttaccggaacccgggtaaacggggtaaccctaacgggtacccggttaacggggtaacgtttaaaccgggtaaccctaaaacgggtttaccggtcggttaaccgggtcgttaaacccggg

SEQ ID NO: 18059 - DNA, 691 bp, Homo sapiens
  misc_feature: GYAE6OF01B14E3.22.59.F04.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtcctccgaggggaaagngccacactctcctgcagggcagtcagagtgtagcagnagtcttagcctggtaccagcaacgaaccgtggaccgaggcctcccgacggcctcccgtcatactagtcgggtanctacgtccgtaacgggacgggtcctaacgtcgggttaccnccccgtagacccgtaggggttacacgggttgggacctaggggttcggggtaccgtaggggactaaggtcgttccacgttctacacccagtcacgcacgcctgngtacgtntagtacgttatttaggacttaggtttactacgttcgtacgacgtacttaagttaaacttaacggttaacccgtcggaaccccgtttacggtaacggtttacccggttttacgggaaacccggtacggggtaaacccctagggtcccggttaaggggaaaccttaaaccgtaaaccgggtaaacccgtaaggttcgggaagggttccctaaacccggg

SEQ ID NO: 18060 - DNA, 679 bp, Homo sapiens
  misc_feature: GYAE6OF01ESH2P.22.59.F04.1.454.CMB.1.raw
tcagacatacgcgtcacgaccggtgctcgatttagtacacacacttagggattgggggaggaactgctcagttaggacccagacggaaccatggaagccccagcgcagtcttctcttcctcctgctactctggcctccctagtttcagactaccacgtggaagaaatagtgactgacgcgacgtcctaccgacgcccctacccgttgtcctgttcgttcctaccggaaggggaaagcgaccactactcctcgtcgcgacgggccagtcagtagttgttacgcagcagtcgtacgccgtacggaccagacgaacgaaccgtggacccgacggtccctacccgaggtccttccgtactactcgtagtcggtcactataccggtacggacggtcctagtacgtaccacccgagtccgtaggttcgaggtcgacgtagggtcgggtacgtagggtaactaggttacgttctacctcctaccgacctagtaccgacgacgtaccgtcctcggactacggtacgttacgtagtttacgtttacgtacgtttagtttactcgtcgtacagtactacttaattacgacgtccggtccgtaccggttacgttacggttccggaacgggtacgggtaccaagggttcgacggtagaactacggtaaacgtacggtcggtcgtcgtacgg

SEQ ID NO: 18061 - DNA, 602 bp, Homo sapiens
  misc_feature: GYAE6OF01C9BD8.22.59.F04.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagacatacgcgtcacgaccggtgctcgatttagtacacacacttagggattgggggaggaactgctcagttaggacccagacggaaccatggaagccccagcgtcagctttctcttcctcctgcttactctggcctcccgtagtttcagactacccatggaataaatgtgacttgacgtctagtcctccgagcccaccgtgtcctgtgtccacgagggaaancgaccacactctacgtnacgagggccagtcaagtagtagtacgnagtcacgtcttaagccgtaggacaagcgaaccgaacccgnacgcttacccagtccaccgttnatcgtagcggtcactactcgtacggacggtcacgnggttaccnccgaagcgtagtacgnggtcgctagggttcgatcgggataggacttccatcgacacgatccagtcngtcgngacngacgtaagagtcgtagtcgtacgttagttatttggtacgaacaggtaacctattaacttagtaccttaccgtacgaagtcgtaccggtacgaccggaaacggtacaaggttgaaaacgtactaaacgtaccggttgagcttaccgcgttaaccg

SEQ ID NO: 18062 - DNA, 701 bp, Homo sapiens
  misc_feature: GYAE6OF01BT3T2.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagtcttagcctggaccagcaagaacctggccaggcctcccgaggtccttcctacacttcgtagtggtgcctatccgtaacggcgggtccacgttcggtacctcccgagcccgtagggttcagggttcggacgtaggtggggtacgtgggacctaggtacgtttccacctccgtaccaccgtactcgacgccacgtcctaggacctacgttacgtaggtaacgtttacgttttacgtaccgttttaagttttacgtttacgttcgttactacgtacctaaactttaaacgttaaaccgttaaccggtccggttaccccgttaaccggtttaaccggtttacgggttttacccgggaacccgggtaacgggggtaacccgtaagggttccggtacgggaaacgttaacgtaaacccggtaaaccggtaacggttcgggtacggtccgtaacccgg

SEQ ID NO: 18063 - DNA, 595 bp, Homo sapiens
  misc_feature: GYAE6OF01C3840.22.59.F04.1.454.CMB.1.raw
  modified_base (312)..(312): a, c, t, g, unknown or other
  misc_feature (312)..(312): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccagtttcagataccactggagaaatagtgatgacgcagtctccagccaccctgtctgtcgtctccgaggggaaagacgccacactctcctgcagggccagtcagagtgtagcagcagcttagcctggtaccagcaagaacctggaccaggctcccaggcctccgcatctagtggtanctatcgtaacggacggcctacgtggtaactcccgagcctaggttcaggtgcgtagtgggtctgggacaggtacgttcacgtctcacctagtcacgcacgctcgcgagtcgtagtaagtactttgtacttagtttacttacttagtactagtacgtaacttaagtaactaacgttacgtccgttaccgttacgttacggttttacggaccggtacggggtaaaaaaccgtggtacgtacgggtaacgtaacgtaaccgaaaacgtagtacggtggtcgtaccgg

SEQ ID NO: 18064 - DNA, 775 bp, Homo sapiens
  misc_feature: GYAE6OF01DWZBL.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaagacgccacactctcctgcaggccagtcagagtgttagcagcagcttagcctaggtaccagacaacgaaaccgtggaccacggcctcccgaggtcctcctacactccgtagtggtgctagtcgtacggacgggcctacgtacggtacctacccgaggtaccctagggttacgagggttcggacgtagggttcgggggtaccgtacggggaacgtaacggttacgtttcccgtaacccgttaccgtaacccgtaacccgttaacgtaccgtaaccggtcccgtaaccggtacccgttggtacccgtaagggttaccgttaagggtaaacgttttacgtttttaccggtaacgttttagtttttaacgttacgtttcggttaccgtaacggtaccttaaacgttaaactttaaacgttaaccgttaccggttaccccgttaaccggttttaaccgttaaccgggtttttccgggacccggtaaaccgggggtaaccaacgggttaccgtaagggtaacgttaaaccgttaaaccgaaaacggtaggtttaccgggtcggtccgtaacccgg

SEQ ID NO: 18065 - DNA, 660 bp, Homo sapiens
  misc_feature: GYAE6OF01DMDHK.22.59.F04.1.454.CMB.1.raw
  modified_base (213)..(213): a, c, t, g, unknown or other
  misc_feature (213)..(213): n is a, c, g, or t
  modified_base (487)..(487): a, c, t, g, unknown or other
  misc_feature (487)..(487): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtcgtctccgaaggggaaancgccacactctcctgcgaggccagtcagagtgtagcagcagtcttagcctaggtaaccagacctaagaaaaccgtggcccgaacggcccttacccgaggacctaccgtactattcgtaagtggtcgtcaacttaccgtaacggacgggaccctacgtcggtactcccgagcctaggttcaggtggacagggttcgggtcgtaggggaacctaaggtcgttaccgaccttccaccaccacgtcaacgtcacggcctggctagttctagtaagttnttttacgacttaacgttttatacgtgtacctaagtactaacgttataaacgttaaccgtgttaacccgttacccgttaacgttacggttttacgggacccggtaacgggggtaacctagggtcgtacgggaataacgtaaccgtaaaacggtagttcggtacggtccgtaacg

SEQ ID NO: 18066 - DNA, 705 bp, Homo sapiens
  misc_feature: GYAE6OF01A73AA.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccagtttcagataccactggagaaatagtgatgacgcagtctccagccaccctgtctgtcgtctccgaggggaaancgccacactctcctgcaggccagtcagagtgtagcagcagcttagcctgaccagcagaacctgccaggctcccgaggcctccgtcactctagtcggtgcctagtccttaaacgggcgggccctaacgtcggtactaccccgagtacccgtagggtttccaagggtttcggacgtagggttcgggttaccgtaggggacaacggttacgtttccgaacgttccgtacctacccgtaacgttccgaacggtaccctaaccggttcccgtaaggtccgtaacggttaccgttaaggtaacgtttacgtttttacgaccgttttaagtttacgtttaccgttacgttaccgtaacggtacttaacctaattaaccgttaccgttacgtacccgttacccggttaacgttaccggttttaccggaccggtaacggggtaaccctaggtacccggtaggtaacgacgttaacggaaactacggtacggtcgtacgttaccg

SEQ ID NO: 18067 - DNA, 769 bp, Homo sapiens
  misc_feature: GYAE6OF01BQJGE.22.59.F04.1.454.CMB.1.raw
  modified_base (214)..(214): a, c, t, g, unknown or other
  misc_feature (214)..(214): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccacctgtcctgtcgtcctccgaaggggaaanacgccacactctcctcgcgacgggccagtacagagtggttagcagcagtcttacgctaggtaccagaccaagaaccgtggccgaggtcccacccgtaggtcctacctacacttcgtagtgggtcaccgtatacccgtaagggaccgggtaccctacggtttacgggtacctacccggacggtaccgtaacgggtttcgaacgggtttcgggaccggtttaaggggttcggggttacggtacgggggtaaacgtacgggttaaaccgtttccgtaacccgttaccgttaacccgtaaaccctaacggtacccgtaaacggtcccgtaaccgtacccgttaccggtaaccgtacgttaccggttaacggttaacggtttagtttacgtacgttttagttttaaccttacgttacgtaacgtacgtacttaacttaagttaaaccttaccgtcggtacccttacggttacgttaccggtttacgggacccgtaacgggtaactacgggtcgttagggaactaaccgtaacgaaacgttacggtcggtcgtagtacccg

SEQ ID NO: 18068 - DNA, 534 bp, Homo sapiens
  misc_feature: GYAE6OF01CBKQJ.22.59.F04.1.454.CMB.1.raw
  modified_base (208)..(208): a, c, t, g, unknown or other
  misc_feature (208)..(208): n is a, c, g, or t
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcaggggaaangccacactctcctgcagggccagtcaggagtgttagcagcagcttagcctggtaccagcagaaacctggccaggcctcccgaggcctcctcactctatggtnctatcgtacggagggccactggtactcccagcctaggttcagtggcaggtgggtctagggacagngttcactctcacntcagtcanctgctagtctagagtntttgctagtttatactgtacagtctataataactaacgtcgtaccttacgtacgttacgtttaccggacgtaggggaccctaggtcgtggaactaacgtacgaaacgtagtgtggtcgtacg

SEQ ID NO: 18069 - DNA, 730 bp, Homo sapiens
  misc_feature: GYAE6OF01CUW73.22.59.F04.1.454.CMB.1.raw
  modified_base (215)..(215): a, c, t, g, unknown or other
  misc_feature (215)..(215): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagactaccactggaagaaatagtgatcgacgcagtctccagcccaccctgtctgtgtctaccgaagggaaancgccacactctcctgcgacggccagtcagtgtgtagcagcagtcttagccgtaggtaccagacaacgaaccgtggaccgacgcctcccgacggcctccgtacattctagtggtcactagtaccgacggacgcctagtcggtacctccgacgtcgtaggttcgaggtcggcgtagggtcggtcgtacgggactaggtaccgttcaacctctacctacgtactacgacgtacgacgttccgacgtacgtcgttagttaacgtaagtttacgttttacgtacgttttaacgttttaacgtttacgttacgtaccgttaacgttaccttaaacgtttaaaccttaaacgttaaccggttacccggttaaccccgtttaaccggtttaaccggttacccggggttttaaccgggaacccgggtaaaccggggtaacccgtaacggttacggtaaccgggtaaataaccggttaaaaccggtaaacggttaaccggttacgggtccgtaccgttaacccgg

SEQ ID NO: 18070 - DNA, 646 bp, Homo sapiens
  misc_feature: GYAE6OF01EFT6X.22.59.F04.1.454.CMB.1.raw
  modified_base (210)..(210): a, c, t, g, unknown or other
  misc_feature (210)..(210): n is a, c, g, or t
  modified_base (639)..(639): a, c, t, g, unknown or other
  misc_feature (639)..(639): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaagngccacactctcctgcgaggccagtcagagtgttagcagcagtctagcctggtaccagacaacgaaaccgtggaccgaggccctacccgaggcctcctcactctagtggtacgctacgtcgtaacggacggtaccagtacggtacctcccgagccgtaggttcgaggtcggacgtaggtcgggtacgtagggactaggtacgttcacctctaccacctactacgacgacgacgcccgtagaccgtagttacgtaaggtaacgttcttttaggactttaaggttttactacgttcgtacgtacgtactaacttaagttaaacgttacgttaccggtaccctttaccggtaacgtttacggtttaccgggacggtaaacggggtacctaagggtcgtagtaacgtaacgtaaccgaaacgtaagtggtacgngtaaccg

SEQ ID NO: 18071 - DNA, 644 bp, Homo sapiens
  misc_feature: GYAE6OF01EX0L0.22.59.F04.1.454.CMB.1.raw
  modified_base (213)..(213): a, c, t, g, unknown or other
  misc_feature (213)..(213): n is a, c, g, or t
  modified_base (459)..(459): a, c, t, g, unknown or other
  misc_feature (459)..(459): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaagngccacactctcctgcgagggccagtcagagtgttagcagcagcttagcctggtaccagcagaacctggccaggcctcccaggcctcctcatctagtggtcgctatcgtacgggacggccacgtcggtacctcccgagtcccgtagggttcgaggtcggcgtaggtcggggtcgtggggaactaggtacgttccacttccgtaccacctatcgagcgacgtccgtgaccgtagtctaggtaagtttnttttcgactttaggttttacttacgttcgtacgtaacgtccttaattaattaacgttaccgtcggtacccgttaccgttagttacgggtttaccgggacccggtaacggggtaaccctaagggtcggttaacgggaagtaaccgttaaacggaaaccggttacgttcgggtcggtcgtaacccgg

SEQ ID NO: 18072 - DNA, 627 bp, Homo sapiens
  misc_feature: GYAE6OF01BIPA4.22.59.F04.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgagggggaaagngccacactctcctgcagggccagtcagagtgttagcagcagcttagcctggtaccagccagaacctggccaggcncccgaggctccgtcatctatggtnctatctacggnggccacgtggtacncccgagccctagggttcaggtggctaggtcggggtctaggggactaggtacgttcacctcctcacctacgtccgagccgacgcctcggccgtacgttacgtaggtaacgttattttggactttacgtttactttacgttcgtactacgtactacttaacttaacgttaccgtccggtcccgttaccggtaccgttacgggttttaccggaccggtaacggggtaacccgaacgggtcgttaagggacgttaaccgtaaccgtaaacggtaagttcggtacgggtctaccgg

SEQ ID NO: 18073 - DNA, 745 bp, Homo sapiens
  misc_feature: GYAE6OF01B7X07.22.59.F04.1.454.CMB.1.raw
  modified_base (211)..(211): a, c, t, g, unknown or other
  misc_feature (211)..(211): n is a, c, g, or t
  modified_base (316)..(316): a, c, t, g, unknown or other
  misc_feature (316)..(316): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanacgccacactctcctgcgagggccagtcagtagtgttagcagcagcttagcctggtaccagcaagaacctggaccaggcctccgaggcctcctcatcctagtggngctatcgtacggacgggccagtggacctcccgagccgaggttccaggtcggacgtagggttggggtccgtaggggaactaggtaaccgtttccaacctccgtacctaacccgtacttaccgaacggtaccgaccggtacccgtacggtaccgtaacggttaccgttaacggtaaacggttacgtttttacggtacgtttaacgttttaactttaaccggttacgttaaccgtaacgtaaccttaaacgttaaacttaaaacgttaaccgttccggttaccccgttaccggtttaaaccgttaccgggtttttaccgggaacccgggtaaaccgggggtaaccctaaacgggtcccgttaagggtaacggtaaaccgtaaaccgtaaaacccggttaaccggttacgggttaccggtaccggttaaccgg

SEQ ID NO: 18074 - DNA, 648 bp, Homo sapiens
  misc_feature: GYAE6OF01D2LH0.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctaggtaccagcagaaaccctggaccaggcctcccgaggtcctccgtcatcctagtcggtgacctagtcgtaacggacggcccacgtggtaacctcccgagtcccgtaaggttccaggttcggacgagggttcggggtccgtaggggaactaggtacgtttacacctccgtaccacctactccagacctcgccgtcgtcacgtcgtacggtaagttacgttttgtacgttagttttaacgttacttagtacgagtacctaacttaagttaaacttaccgtaccggttacccttacccgttaagttccgggttttacgggacccggtaaggggtaacccgtaaggtcggtacggaacgacgtaaccgaaacgtaccggtgtacggtcgtaccg

SEQ ID NO: 18075 - DNA, 748 bp, Homo sapiens
  misc_feature: GYAE6OF01CP29I.22.59.F04.1.454.CMB.1.raw
  modified_base (219)..(219): a, c, t, g, unknown or other
  misc_feature (219)..(219): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccacgtggagaaatagtgaatggacgcagtcctccacgccaccctgtctgtgtcctaccgaagggggaaancgccacgacctctccgtgaccgacgggccagtcgagtaacgttgttagcaaggcgagtcgttacggcctaggtaccagcaacgaaccgtggacccaggctaccccgaggtacctccttnaattcgtgtacgggttnacctacgttaccgacgggaccggtccgtacgtacgggttaccttacccgaggaccgttagggtacgtaggtaggtaccgtaggttcggggtacgtacgggaacgtaggtacgttaccggtacctaccgttaccgaaccttaccgaccgacggtacgtaccggtccgttacgggaccgtttaagttccgttaagggttaacgtttacgttttacggacgttttaacggttttaaacttacccggtttagacgttacggtacctaaacgttagttaaacgttacccgtacggttcccgttaaccgttagggtttaccgtttgggtaaccggtaacgggtacgaacgtggttaacgacgtaacgtaccgaaaccgtagtacgttcgggactaccgg

SEQ ID NO: 18076 - DNA, 709 bp, Homo sapiens
  misc_feature: GYAE6OF01A2KU1.22.59.F04.1.454.CMB.1.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatggacgcagtctccagcccaccctgtctgtgtctccgaagggggaaanagccacactctcctgcgacgggccagtcaggngtgttagcagcagtcttagcctggtaccagacaagaaaccgtggccgaaggcctaccccgagggtcctccctcattcctagtcggtcncactcctaacgggacggcctaagtcggtactacccgaggaccctagggttcaggtcggacgtaggttcgggtacggtaggggtaaccgaggtacgttaccaccgttactacccgtaacccgtactaccgaacgggtaccaaccggtacccctagggtacccgtacggttaaccgttaagggtaaaccgtttaacgttttaggtacccgtttaaggtttttaacttacgttacgtacgtacgtaacctaacttaacgttaaacttacggtacgtacccgttacgttacggtacggtttacgggaccggtaaccggggtaacacggtacgtaggtaacgaacgtaaacgaaacggtaacgtcggttacggtcgtacg

SEQ ID NO: 18077 - DNA, 750 bp, Homo sapiens
  misc_feature: GYAE6OF01DG67Q.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactcctcctgcagggccagtcagagtgttagcagcagcttagcctggtaccagcaagaaacctggaccaggcctcccgaggtcctccgtcattccgtagtcggtgactagttccgtaacgggacgggtccctacgtcggtaactccccgagtccgtagggttcagggttggaccgtagggtcgggtacgtagggaaacgtaacgtaccgtttccacgttcctaaccgtaacccgtaactaccgaaacccgtacggtaccgtaacggaccggtacccgttacggtaaccggttaacgtttccgtacggtaaccgtttaaggttttttaccttaaccgttcggttacgtaaccggtaccgttaacgggtacccggttaaccgtaacgggttcccgggtacccgtttacccgggttaccggtttaccggggaccccgggtaacgggggtacccgtaaacggtaccgggttacgggtaacggtaacgtacccgaaacggtaacccggtaacggttcggtacgggtccgttcggaacccg

SEQ ID NO: 18078 - DNA, 717 bp, Homo sapiens
  misc_feature: GYAE6OF01D5330.22.59.F04.1.454.CMB.1.raw
  modified_base (217)..(217): a, c, t, g, unknown or other
  misc_feature (217)..(217): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactcttgcctcccagtttcagataccactggagaaaatagtgatgacgcagtctccagcccaccctgtctgtcgtctaccgaagggggaaanacgcccaacacttcctccgtggcgacggggcccaggttccaaggtagttgtaacgcaggcagtcttacgccgtaggtaccagacaacgaaacctgggaccaggccctcccgaggtcctaccgtacacttcgtagtggtacgctaatcgtaacggcgggtaccacgttcggacctccccgaaggtacccgtaagggtttcaaggggtcggaccgtaggggttcggggttaccgtaggggtaacgttaacggtttacgttttaaacccgtccttacggaaaccccttgtaaccgtaacggccgtaacgccgttacggaccgtaggttcctaaggaagtgtggttacgggtactttagtttaacgttcgagttccaaggtcttaaagttactttactaccgttcctacgtaccgtaagggttcccgttacggaacccggtaacgggtaaccgtaagggtacgaaaactacgaaacggttcgaggtacggtactcgaccgtaac

SEQ ID NO: 18079 - DNA, 714 bp, Homo sapiens
  misc_feature: GYAE6OF01A0KT2.22.59.F04.1.454.CMB.1.raw
  modified_base (210)..(210): a, c, t, g, unknown or other
  misc_feature (210)..(210): n is a, c, g, or t
  modified_base (313)..(313): a, c, t, g, unknown or other
  misc_feature (313)..(313): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgtagcagcagcttagcctggtaccagcagaaacctggaccaggcctcccgaggcctcctcatctagtcggtncatcgtacggacgggccacgtggtactcccgagtccgtaggttccagtcggctaggtggggtcgtaggggtacaggtacgtttccaacgttcctaccgtaaccctacgtaccgacggaccgtaacgtacccgttcggtaccgtacggttacgttaacgggttaaacgtttacgtttttacggacgttttaaggtttttaacgtttacgttcgttaccgtaaccggtaccttaaacgttaacgttaaaccgttaacgttccgggttacccttacccggttaacgttaccgggtttttaccgggacccgggttaacggggtaacccgtaagggttcggttaacgggtaacgttaaccgtaaaccgaaaccgggtaacgttcgggttaccggtaccgttaccgg

SEQ ID NO: 18080 - DNA, 710 bp, Homo sapiens
  misc_feature: GYAE6OF01CLR9A.22.59.F04.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (411)..(411): a, c, t, g, unknown or other
  misc_feature (411)..(411): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagactacccacgtggaagaaaattagtgaatcgacgcagtcctccacgcccacccgtgtctgtgtccgtaccgaggggaaancgccactacctctacngacgacgggcagtcgagtacgtgttaacngacgacagtcttacgccgtaggtaaccaggaccgaaacgtaaccgcggacccgtacgtaccccgccccgaagtccttaccctacaagttcctaggtcgtacgactacgtaccggtacggcggtaccacgtacggtaaccnccgagtcccggtaggttaccaggttcgcggtaggttcggtacgagggtaactaggtactcgaccgtcctaccgacctacgacacgccgtaagccgtacgtacgtataccgtaagttaacgtttacgtttacgtacgttttaagttttacgttaacggttctaacgtacgtaacctttaagtaacgttaaacgtacgtaccgtaaccgttccgtaacgttccggtacggtacccggtaagggtacctaaggtggaacgtacgtaacgtaaccggtaaactccgtaggtaccgtcgtaccg

SEQ ID NO: 18081 - DNA, 639 bp, Homo sapiens
  misc_feature: GYAE6OF01EOVK6.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaaacctggaccaggcctcccgaggcctccctcatcgtagtggtgcatcgtacggaggccagtcggtactcccgagcctaggttcagtcggctaggtgggtcgtggggactaggtacgtttcactctaccgacctatcacgccaacgccctggacctagttcgtagtaacgttagttttcgacgtttaacggttttaactacgttacgttaccgtaacgtacctaaactttaagttaaacgttaccgtacggtcccctttaccggttaacggtttacggttttccgggacccggtaacgggggtaacccgtaacggtcgttagggaacgtacttaaccggaaacgtaaccgttggtaccggtcgtaccgg

SEQ ID NO: 18082 - DNA, 851 bp, Homo sapiens
  misc_feature: GYAE6OF01CTB59.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctctttcctcctgctactctggctccagagaccaccggagaagttgtgttgacacagtttccagccaccctgtctttgctccaggagagcgggccaccctctcctgcagggccaatgagagtattagacgactacttagccttggaccaagagaggtcctggccaggcctacccagggtcctcctcagttagtattgaagtgtaccgtttaacccgaaaaaggggcccaacgttcgggaccactacccccgaggaccccgtaggggtttaccaaggttcgggaccaagggtttcgggggttaccgttaagggggaaaagacgggtaaacccttttccgaacctttccttaccgaaacccctaaacgttacctaaaaaccgacgaaccccgttaacggaacgtacccggttacggaacgggtaaaccgtttaccttacgtacggttaaaccgttttaagtttaaccttacgggttaactaacggtaccgaacgggtacccggttaaacccggtaaacgggtttaccggggttaaccccgttacccgggttaaccccggttttttaacggggacccccgggtttaaacgggggggaaccccttaaacggggacccggttaagggaaaggtaaccggttaccgtaaacgggaaccggtaaacggttacgggttacgggtaccgttacgacccgtaaaccctacgttacgtttacgtttaccgttacctacggttttacccccg

SEQ ID NO: 18083 - DNA, 680 bp, Homo sapiens
  misc_feature: GYAE6OF01CDE73.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaggggaaagacgccacactctcctgcgagggccagtcagtagtgtagcagcagtcttagccgtaggtaccagaccaagaaccgtggacccacgggcctcccgaggtcctcctacgatctagtcggtgactacgtcgtacggacggtaccctagttcggtacctcccgagtccgtaggttacaggtcggacgtaggtcgggtcgtagggactaggtacgttcctacgtccgtacacctacgtcgacgccgacgtcctacggtcgtacgtacgtagtaacgttagtttacgtacgtttaacgtttacttacgttgtacgtacgaccttaacgttaacgttaacgttaaccggttcggtacccgttaccgttaacgttacggtttacccgggaaccggtacggggtaacccgtaacggtcgggtaacggtaacgtaaccgtaaacggtaaacggtaacggtcggttacgggtcctaaccgg

SEQ ID NO: 18084 - DNA, 601 bp, Homo sapiens
  misc_feature: GYAE6OF01BABIU.22.59.F04.1.454.CMB.1.raw
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaagacgccacactcctcctgcgagggccagtcaggagtgttagcagcagcttagcctggtaccagcagaacctggccaggcctcccgaggcctcctcactcgtagtggtnactacncgtaacggcggtccagtcggtacnccacgtccaggtcagtggctaggtcggtcgaggacaggtctcactcncgactatcgagcacgcgtnacgtgtacgtagtaattgtttagcgttttaagttnttacggcttaacgacgtactaattaagtaacgtaggtcccgtaacccttcgggttaccgttagggttacggaacccgaaccgggtaccgtaagtccgggtaacggaattccgtaaaccgtaacggtacgttacggtcgggtcgtacccgg

SEQ ID NO: 18085 - DNA, 832 bp, Homo sapiens
  misc_feature: GYAE6OF01C0MPA.22.59.F04.1.454.CMB.1.raw
  modified_base (216)..(216): a, c, t, g, unknown or other
  misc_feature (216)..(216): n is a, c, g, or t
  modified_base (343)..(343): a, c, t, g, unknown or other
  misc_feature (343)..(343): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggcctcccagtttcagactaccactggagaaatagtgatgacgcagtctccagcccaccctgtctgtcgtcctcgaaggggaaangccacactcgtcctgccgagggccagtcgagtagttcgtagcagcacgtcttacgccgtacggtaccagaccaacggaaaccgtggaccgacggctacccgaggcctaccgtctactctagtcggtnactacgtacgacggtacgggacctacgtgggtaacctccgacggtaccgtacgggttacgagggtcggacgtacgggttcgggtacgtacggggtaactaacggtacgttaccgtacctaccgtacctaacccgtacgttaccgaacgtaccgaccggttccctacggtaccgtaacgggttaccgtaacgggttaaacggtttaccggtttttaggtaaccgtttttaacggttttaaccgtttaaccggtttagttaacccgtacgttaaccgtaacctttaaacggttaaactttaacccgggttaccggttaccccctttaaacggggtttacccggttaccggggtttttaacccgggaccggggtaaaacccggggtaaccgttaaacgggtcccggtttaaacggggtaaacggttaacccggttaaaaaccgggtaaacccggtttaacggtccggggttaacggtaccggttaaaccccg

SEQ ID NO: 18086 - DNA, 640 bp, Homo sapiens
  misc_feature: GYAE6OF01EWDE7.22.59.F04.1.454.CMB.1.raw
  modified_base (211)..(211): a, c, t, g, unknown or other
  misc_feature (211)..(211): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaggggaaangccacactctcctgcagggccagtcagagtgttagacaactaacttagtctggtaccagcagagacctggccaggcctcccgaggcctcctcatctagtggtctccttcaccgagggccacgtcggtacctcccccggctaggttcagtcgccgtaggtgggtctgggacaggtacgttccacgttcctaccgtaaccctagtccgtaacggccgacggtccccgttagccgtaacgtccgtaaggtaagtttattttccgactttaacttttagttacttgtacagtacctaaatagttaacgtgttaccttaggttcctacgtacttccgtacccgttcgggaaccgtaaagggacctaccggtacggtacgggtaacgtaaacgttaaaccgtacggttacggtacggaccgtacgcccgtaaccg

SEQ ID NO: 18087 - DNA, 636 bp, Homo sapiens
  misc_feature: GYAE6OF01A6W3T.22.59.F04.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (404)..(404): a, c, t, g, unknown or other
  misc_feature (404)..(404): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcaggccagtcagngtgttagcagcagcttagcctggtaccagcaagaacctggccaggcctcccaggcctcctcgatcttagtggtcgcactcgtaacgggacgggtacctacgttcgggtacctccccgaaggtccgtaagggtttcaggtcggcgtagggttcgggtcgtgggaacnggtagttcccaacgttccgtacctaccgatccgacgacacgccgtacgctacgtctaggtaagtcgtttgacgttagtttattcgtagtacgagtacctattaactaacgttaacgtacggtccttaccggttacgttacggtttacggaccggtaacggggtaacccgaacgggtcgtacgggtaaacgaccgttaaacgaaacggtaacgtttcggacggtccgtaccgg

SEQ ID NO: 18088 - DNA, 721 bp, Homo sapiens
  misc_feature: GYAE6OF01BQIDO.22.59.F04.1.454.CMB.1.raw
  modified_base (212)..(212): a, c, t, g, unknown or other
  misc_feature (212)..(212): n is a, c, g, or t
  modified_base (331)..(331): a, c, t, g, unknown or other
  misc_feature (331)..(331): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagccaccctgtctgtgtcctccgaggggaaanacgccacactctcctgcacgggccagtcagagtgttagcagcagtcttagcctaggtaccagcaaggaaccctggcccagggcctcccgaggcctccctactacgttcgtagtgggtcncctacgtccgtaaccggacggggtcccctaagttcgggtaacctccccgaaggtcccgtaaggggtttccagggtcgggaccgtagggttcgggggttcgtacgggggtaactaacgggttacgtttcccaaccgttccgtaccctaccctaacgtacgtaccggaccgtaaccggcccgtacggtaccgtagttccgtaggttaacgttacgttttcgtacgtttaacgttttaactttacgttcggttacctacgtacgtaacttaacttaacgttacgtacggtacccgttaccgttaacgttacggttttcggaccgggtaccgggtaaccgtaacggtcgtacggaacgtacgtaaccgtaaacggtaccgtggtcggtcgtacg

SEQ ID NO: 18089 - DNA, 704 bp, Homo sapiens
  misc_feature: GYAE6OF01B2GDF.22.59.F04.1.454.CMB.1.raw
  modified_base (205)..(205): a, c, t, g, unknown or other
  misc_feature (205)..(205): n is a, c, g, or t
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
tcagacatacgcgtcacgaccggtgctcgatttagtacacacacttagggattgggggaggaactgctcagttaggacccagacggaaccatggaaaccccagcgcagcttctcttcctcctgctactctggctcccagatattactggagacgttgtcttgacgcagtctccaggccaccctgtcgctgtctccgaggggaaancgcccaccctcgtcggtagtaacggccagtcagtaatacgttaacaacagtaatagtagtacgcctagggtactaccgagacgaggacgtacccgtgggacctacgttaccgttccccgttcttaccccttcggttcgtttcgggtacggcccgggttaccggaaccggtaccggggacccgacgggggacctaccgttcccgtaggaacctacgtactttccggaggtcgggccgtacggggttcggggtacccggtacagtaccttacgtcgtacgaccgtacaccgtaggttccgggacggttccgacggtaccaggtaactcgtttcacgtctaacttaattacgttacgtgtactacgttctttagttagttaccttccgtacgttcgtactattacgttcgttaccgggacgacgggtactagcggtagactagtaaccgaacgttacgnggtcncgtacgacctacgttatccgtttattcccgtatacccg

SEQ ID NO: 18090 - DNA, 593 bp, Homo sapiens
  misc_feature: GYAE6OF01ALHQM.22.59.F04.1.454.CMB.1.raw
  modified_base (212)..(212): a, c, t, g, unknown or other
  misc_feature (212)..(212): n is a, c, g, or t
  modified_base (321)..(321): a, c, t, g, unknown or other
  misc_feature (321)..(321): n is a, c, g, or t
  modified_base (581)..(581): a, c, t, g, unknown or other
  misc_feature (581)..(581): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagccaccctgtctgtcgtctccgaggggaaanagccaacactctcctgcagggccagtcagagtcgtagcagcagcgttagcctggtaccagacagaaaccgtggaccgaggcctccgaggcctcctcactcgtatggtancatccacggaggtcccagtcgtacaccgagcgtaggtcaggtgacgtaggtcggtctacgggactagtccgttacacgtcctacacgtagtcagctaccgctgacgtacgttacgacgtaaggttacttttacgacgtttaagtttaactacgtacgttactagaacctagttaataaacctaagtcgacccgttacgtacgttaacggtttcggaccggtaaggacccgtaagtctacgggtatacctaacgaacgtanggtacgctacgg

SEQ ID NO: 18091 - DNA, 759 bp, Homo sapiens
  misc_feature: GYAE6OF01DLCPE.22.59.F04.1.454.CMB.1.raw
  modified_base (218)..(218): a, c, t, g, unknown or other
  misc_feature (218)..(218): n is a, c, g, or t
  modified_base (495)..(495): a, c, t, g, unknown or other
  misc_feature (495)..(495): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctggcctcccagtttcagataccactggagaaatgtgatggacgcagtctccagcccaccctgtctgtcgtcctaccggaaggggaaancgaccacactcctcctggcgacgggccagtcaggtagtgtacgcagcgagtcttacgcctggaccagacaagaaccgtggaccaggcctccgagtcctccgtctactacgtagtcggtcactacgtaccgtacgggaccggtcctacggtacggtacctcccgagccgtaggtcgtcgggtcggcgtagggttggggtaccgagggtacgtagtacgttcctaccgtccgtacaaccgtatacggacgcgtaaccggtcctacgggtactacggttntaacggttaaagtttccttttagggtaacttttaaggttttacgtacgtaccgggtaacctacggttaacctaaacgtttaaacgttaaccgtttacccggtacccggttaacccggttacccgtttaacgggtttacgggtttacccgggtaaaccccggggtaacggggtaaccttaaacggggtccgttaaaggggaccgtttaaaaccgaacccgggttaaaacggacgggtttcgggtacccggtccgttaaacccggg

SEQ ID NO: 18092 - DNA, 657 bp, Homo sapiens
  misc_feature: GYAE6OF01A3OZI.22.59.F04.1.454.CMB.1.raw
  modified_base (97)..(97): a, c, t, g, unknown or other
  misc_feature (97)..(97): n is a, c, g, or t
  modified_base (315)..(315): a, c, t, g, unknown or other
  misc_feature (315)..(315): n is a, c, g, or t
  modified_base (640)..(640): a, c, t, g, unknown or other
  misc_feature (640)..(640): n is a, c, g, or t
  modified_base (649)..(649): a, c, t, g, unknown or other
  misc_feature (649)..(649): n is a, c, g, or t
tcagacatacgcgtcacgaccggtgctcgatttagtacacacacttagggagttgggggaggaactgctcagttaggacccagacggaccatggaanccccagcgcagcttctcttctcctgctactctggcctcccagtttcagataccactggagaactagtgatgacgcagtctccagccaccctgtctgtcgtctccggagggaaacgcgccacgactctcctgcgacgggcagtcacgtgtgtacgcagcagtctacgtcctcggtacagtcaagtaaccgtggccgagccctacccgacggtcctaccnctactacgtgttgggtcacgtacgttcgacggtaccggctaggtacgtacctaccgacggtaccgtaaggttaccagggtcggacgtagggtcggtcgtaggaacgcggttactcaacctccgtaccgaccctagtacccgagccgtaaccgtacgtaccgtatacccggttaatttaaccggttacttttacggattttaacgtttaacgtcggtacttacgaccgtacgacgttaccgattaccccgtacgttaccgtcggttaccggtcggaacgggtacggaacggtaggataacgtactacccgaagtcgtggaccgtancggtacctnttacccgg

SEQ ID NO: 18093 - DNA, 745 bp, Homo sapiens
  misc_feature: GYAE6OF01EDWDC.22.59.F04.1.454.CMB.1.raw
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacncagtctccagccaccctgtctgtcgtctccgaggggaanacgccacactctcctgcgagggccagtcagtgtgttagcagcagtcttagccttaggaccngacagaacctggccagggtcctacccgaggtccttacccgtacacgttctaggtcggtacactactccgtaacgggacgggtcctacggttcggtacctacccggacggtcccgtaaggtttccggaaggttccggacggtacggtaggggtttaccgacggggtaacctaagggttacgtttacccgaccgttacccgttacccgaacccgtagtacccggaacgtccgtaaccggtccgtacgggtacctacgggtttacctaaggttaaaccgtttagttttaccgggacttttaaaggttttacgttaacgttcggtaacccgaaggttaccttaaacgttaacttaacggttaccgtcggttacccgttacgttacggttacggtttaccgggaccggtaacggggttaacaacgggttacgtaaaacctaacggtaacgtacggttcgacggtactaccggactaccg

SEQ ID NO: 18094 - DNA, 686 bp, Homo sapiens
  misc_feature: GYAE6OF01A3XBU.22.59.F04.1.454.CMB.1.raw
  modified_base (213)..(213): a, c, t, g, unknown or other
  misc_feature (213)..(213): n is a, c, g, or t
  modified_base (366)..(366): a, c, t, g, unknown or other
  misc_feature (366)..(366): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagcccaccctgtctgtgtctccgaaggggaaangccacactctcctgcagggccagtcaggagttgttagcagcagtcttagccgtaggaccaggaccaacgaaaccgtcggccacgggcctccccgaggtcctcctcactctagtcggtcgctagtccgtaacggcgggtaccacgttcggtacncccgagccgtagggttcaggtcggcgtagggttcgggtacgtaggggtaaccagggtacgtttaccaaccttcccgtacctaaccgtactaccgaacgtaccgacgtcccgtaggtaccgtaacgggttacgtaacggttaaagtttacgttttacggtacccgttttaagtttttaccgttacgttacggtactaacggtaccttaacttaattaacgttaacgtccgtacccgttaccgttacgttcggtttacgggaccgtacggggtaaccaggtcgtaggataacgtaaccgaaacgtacgtggtcgacgtaccg

SEQ ID NO: 18095 - DNA, 603 bp, Homo sapiens
  misc_feature: GYAE6OF01B8A9F.22.59.F04.1.454.CMB.1.raw
  modified_base (207)..(207): a, c, t, g, unknown or other
  misc_feature (207)..(207): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgagggaanagccacactctcctgcgagggccagtcagagtgttagcgagcagcttaggcctaggtaccagcacgaaacctggacctaggcctcccgaggcctcctcacttccgtagtcggtacactagtacgtacgggacgggtaccctacgttcggtaacctcccgaggtcctagggttcaggtcggcgtaggttcgggtcgtagggactaggtacgttcacgtctaccgactatcgagacctagcctgacctagtctagtagttagtttcgactttagtttacttacgtgtacacgtacgtaacttaataacgtacgtacgtacccgttcgttacgtaggttccggaccgtaacgggactaggtcgtaggagtaacgtaacgtaacgacgtggcgtcgtacg

SEQ ID NO: 18096 - DNA, 905 bp, Homo sapiens
  misc_feature: GYAE6OF01CC693.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagataccactggaagaaatagtgatgacgcagtctccagcccacctgtctgtgtctcgaagggaaagcgccacctctcctgcacgggccagtcagtagtgttaagactaaacgtaacttgtcgtaggtaaccaggtcaaggacgaccgtggaccgtacggtcctacccgaggtcctccgtacaacttccgttaagtcggttacgtccctttaccgtaacccggacggggtccctaaacggttcgggtaaccccgtcccccggacgtaacgggtttaccgacggttacggcccgtaagggtttcgggggtaccgtacggggaacctaacgggttacgtttaccaccgtttaccacccgtaaaccctagttaccgaacggtccgtaaccggtcccgttacggtaacccgtaaggttcccgttaaacgggtaaaaacgtttcgtttttaccgtaaccgtttttaaaccttttttaaacgtttaacccggttagtttaacccgtaaagttaacctttaaaagtttaaacgttaaacggtttaacggttaacccggtttacgggtttaccgtaacccgggttaacttaccccgtaacccggtttaccgggaaaacccgttaaacggggaaaccccgtaaaggggtaaaccggttaacggggttaaaacggttaaaaccggttttaaaaaacccgggtaaccgggttacgggttaacccgggttaccgtaccggttaaaccccgtaacccgttaccgttaccggttttacccgg

SEQ ID NO: 18097 - DNA, 734 bp, Homo sapiens
  misc_feature: GYAE6OF01CYO3D.22.59.F04.1.454.CMB.1.raw
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
tcagacatacgcgtcacgaccggtgctcgatttagtacacacacttagggattgggggagaactgctcagttaggacccagacggaaccatggaacgccccagcgcagcttctcttcctctgctactctggcctcctagtttcagactaccatgganaaatgngatgacnctagtcctacacgccaccttgtctgtacgtccacggaagggaatcgacctacacttcncngacgacggtcagtcgaagacgttagtacgacgacgactagtaccgtttaacgccggttaacgggtaaccaacggaccgtaaaccggtaaacccgtggtaacccgtaacggcccgttacccggaacggtcccttacccttacgaacttaccgttaaggtccggtactacgaccgttaccggaacggtaccggtaccttacgggtaggtaccctccgtaacggtaccgttaggttaacgacgggacggtacggttaagggttcggtaccggttaggacttaaggtaccgttactaccgtaccgtacgaacttacgacgtacgaccgtacgcgtaaccgagtacgttacggtaacgttagtacgtttacgtaacgtttacgttaagtacctgtaactacgtaacttacgaaattacgtacgaccgttacgtaacgttacgtaggttaccgagggtaccgtaacgaggtcgtaacgactaaagtaccgtaaagtcggtactgtacacg

SEQ ID NO: 18098 - DNA, 745 bp, Homo sapiens
  misc_feature: GYAE6OF01BIXE7.22.59.F04.1.454.CMB.1.raw
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagcccacctgtctgtcgtctccgaaggggaancgccacactctctgcgaggccagtcagagtgttagcagcagcttagcctggtaccagacaacgaaccgtcggccgaggccctacccgacggtccttccctactacgttactaggtcgggtacgactacgttaccgtaaccgggacggtacctacggttaccggtaaccgtccccgaacggtcccgtaacgggttaccgtacgggttacggacggtaggggttcggggttaccggtacggggtaacctaggttaccgtttaccgtaacccgttccctaccgtaacccgtagttaccgacgtaccgaaccgttccgtagaccgttaggttacgtaacggtaaacgtttctttaacggacgttttaacgtttacgtacgttcgtactaccgtaacttaacgttaattaaactaccggtcgtaacccgttaccgttaccgtttagggttacccggaccgggtaacgggaacctaacgggtcggtaacggtacgttaaacgtaaccgaaacggtacgttgggtacccgacggtacccg

SEQ ID NO: 18099 - DNA, 737 bp, Homo sapiens
  misc_feature: GYAE6OF01B0KRZ.22.59.F04.1.454.CMB.1.raw
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggcctcccagtttcagataccactggagaaatagtgatgacgcagtctccagcccacctgtctgtcgtctccgaaggggaaanacgccacactctcctgcacgggccagtcagagtgtagcagcagtctagcctggaccagcaagaaccnggccaggcctaccgagctccatactctagtcgtgctatccgtaacggacggcctaacgtcggtaaccncccgaagccgtaaggtttcgaaggtcggaccgtaggtcggggtacgtacgggaactaaggtacgtttacctaccgtactacccaacctacgtaccgaacgtaccgaacgtccgtacggacgtacggttacgttaacggtaaacgttacgtttttagggttaacctttaaggtttttaaccgtttacgttaccggttacgtaaccgtacgtaaaccttaaagttaaacgttaacccgttacggttaccccgtttaaccggtttaaccggttaaacggttttccgggtaaacccggtaaccgggggaaacccgtaaccgggtacgtacgggtaaacggtaacgtaaaccgtaaaaccggtaaacggtttacggacggttccggtaaccgg

SEQ ID NO: 18100 - DNA, 861 bp, Homo sapiens
  misc_feature: GYAE6OF01ETXS3.22.59.F04.1.454.CMB.1.raw
  modified_base (164)..(164): a, c, t, g, unknown or other
  misc_feature (164)..(164): n is a, c, g, or t
  modified_base (268)..(268): a, c, t, g, unknown or other
  misc_feature (268)..(268): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctggcctccctagtttcagactaccacgtaggaanaaatagtagatggaccgctagtcctaccgaacgccctacccgtggttctcggttcgtccgtaccggaagggggaaacgcgacccaacgtaccttccgttaccgnggaccggacgggacctaaggttaccaagggttaggttacggttacgacgtaacggtaccgtaacgttaccgtttaccgggtacccgttacgggtaaacccgaggtaacccgaaaacggtaaccccgtggaccccgtaacgtcccgtacccgacgtccctaccgttactaacgtcgttacgtcggttaccacgttacttaaccgggaccgggaacggtaccctacggtacggttacctaccccggagttaccgtaagggttcgggtaacgtcgggtaacggttccggggttaggtaccgggtaacgggtaacgtaccggttaacggtttaccctacgttacccgtaacccgtacgtaacgttacgaccctaccggtacgtacccgtacgtacgtacgtaacttaacgggttacgtttacgttacggtacgttttactttacgtcttagtaccacggttactaaacttaaacgttacggttaaccgtaccgtaaccgtttcggtaacggttccggttacgggaaaccggtcgggaaacttcggtagaacggtaactaacgtaaaccggtagtaacccggtgtaacgcgttaaccg

SEQ ID NO: 18101 - DNA, 608 bp, Homo sapiens
  misc_feature: GYAE6OF01BBWOO.22.59.F04.1.454.CMB.1.raw
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggctcccagtttcagataccactggagaaatgtgatgacgcagtctccagcccaccctgtctgtcgtctaccgaggggaaagcgaccactacttctcctgcacggccagtccagtagtgttagcagcagcttagcctggaccagacagaacctggccaggcctcccgaggtcctccgtcacttcgtagtggtnactagtccgtacggcggtaccacggtgtaccncccgagtcctaggtcgaggtcggacgtaggtcgggtacgcgggatagtacgttcacgttccgtacacctattcgacgcgtacgtccgtagacgtagtcgtagtaagtttctttcgagtttatttacgtcgtgtacacgtactaattaataacgtaacgtccggtaccttacggttacttcggtttaccggaccggtaagggtacctaggtcgtaggactaacgtaaccgtaacgtagtcggtggaccgtacg

SEQ ID NO: 18102 - DNA, 812 bp, Homo sapiens
  misc_feature: GYAE6OF01D2U9L.22.59.F04.1.454.CMB.1.raw
  modified_base (228)..(228): a, c, t, g, unknown or other
  misc_feature (228)..(228): n is a, c, g, or t
tcagacatacgcgtcacgaccggtgctcgatttagtacacacacttagggattgggggaggaactgctcagttaggacccagactgaaccatggaacgccccagcgcagcttctcttccctcctgctactctggcctccctagtttcagactaccagtggaagtaaatgtagagtgacgcagtcctccacgcccaccgttgtctgtcgtccgtaccggaaggggaaanccgaccactactcctccgtgacgacggccgagtcgaagtaggttagtacgcgaagcgtacgtacgttaccgtccgtacggtaaccgagaaccgaaacggacccgtacggcccgtacggtccccgtaacccggacggtcccttacccgttcgtaaacgttggtaacgtacggtaccttccggtaaacccgtaaacccgggaaacggtccccgtaacggtaccggaccctaccgtaccccggaacggtacccgtacgggtacgtacgggtacggacggttaccggggttagggtacggttaacgggaaccgttaacgttacctacctaccgttacccaccgtaaacctacgtaaacccggacgtaccgacggtacgcccgttacccgtagttaacccttcgtttacgtcgttaacgttttctttaaccgcgttacgaacgtactaccgggaccgtttaccggaaaccgtcggttaccctcccggtttaacccgggttaggtacccggggccggtaaccgggtactagggtcggtaccaagggtaccttaaccggggacgttaaccgtgggctaacggtcctaacgg

SEQ ID NO: 18103 - DNA, 758 bp, Homo sapiens
  misc_feature: GYAE6OF01EFV87.22.59.F04.1.454.CMB.1.raw
  modified_base (236)..(236): a, c, t, g, unknown or other
  misc_feature (236)..(236): n is a, c, g, or t
  modified_base (498)..(498): a, c, t, g, unknown or other
  misc_feature (498)..(498): n is a, c, g, or t
  modified_base (569)..(569): a, c, t, g, unknown or other
  misc_feature (569)..(569): n is a, c, g, or t
tcagacatacgcgtcacgaccggtgctcgatttagtacacacacttagggagttgggggaggaactgctcagttaggacccagacggaaccagtggaacgccccagcgcagcttctcttcctcctgctactcgtcggcctccctagtttcagactaccagtaggaagaaagtagtgatcgacgtacgacgtcctaccgacgaccctacccgtgtctgtcgtcgtacgaagggaacncgaccacgactccgtcgtcgacgacggccagtacgaggtacggttagtacgacgacgtacgtacgttacgttaccggaccgttacggaaccgaggaaacctaacggaaaccgttcgggaccgaaccggtccccgtacccgtacgtcccttaccgtactaaccgtccgttaaggtcgtacgtaccgttaacgttaccgggtaaccggaccggtacccgtaacggttaaccgtacccgtaccgacggtaccgtaaagggttcgngggtaacgcgggttacggtcgggttacggaacgtagtacgtacttaccgactcgtaaccaacgtgacgacncgtacgacgtgtaactcggtataacggtagtttacttcgtagtttaacttgtacgtagtacgtactaactaacgttaagtaacgtagtaccgtaccgtaagttacgttacggtacggtaaccggtcgaacgtacggttagacggttaaccaaaggtaccctaaacggttacgtgtaccgtcgtaaaccg

SEQ ID NO: 18104 - DNA, 698 bp, Homo sapiens
  misc_feature: GYAE6OF01AZSDI.22.59.F04.1.454.CMB.1.raw
  modified_base (159)..(159): a, c, t, g, unknown or other
  misc_feature (159)..(159): n is a, c, g, or t
  modified_base (233)..(233): a, c, t, g, unknown or other
  misc_feature (233)..(233): n is a, c, g, or t
  modified_base (599)..(599): a, c, t, g, unknown or other
  misc_feature (599)..(599): n is a, c, g, or t
  modified_base (683)..(683): a, c, t, g, unknown or other
  misc_feature (683)..(683): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctggctcccagtttcagataccactggaanaaatgtgatgacgcagtctccagcccaccttgtctgtcgtcctccggaaggggaaacgcgaccactactcctcncgcgacgggaccagtacaggtagttgtacgcacgcacgtacttacggccgttacggtaaccagaccaacggtaaacccgtcgggacccacggccctcccggagtccctccgtactacgttcctaggtcggtctacgttacgtaccggtaaccgggacggtacccttaaccggtacggtaccgtccgaacggtcgtaccgggttcgagggttcggacgtagggttcgggtcggaggggtaaccgtaggttaaccgttcaaccgttccaacccgaaccgtactacggacgtccgacgttccgacgtccggtagttaccgtagttaacgttttcgtttagtactttagttttaacgtcgtcgtacgtanaccttaaagtaattaacgttctacccgtcgttacgttcgtacggttcggcggtaacggctaggtgacgtatacgaacggtaacnggttcgtgcctaacg

SEQ ID NO: 18105 - DNA, 770 bp, Homo sapiens
  misc_feature: GYAE6OF01BCTUO.22.59.F04.1.454.CMB.1.raw
  modified_base (127)..(127): a, c, t, g, unknown or other
  misc_feature (127)..(127): n is a, c, g, or t
  modified_base (162)..(162): a, c, t, g, unknown or other
  misc_feature (162)..(162): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
  modified_base (478)..(478): a, c, t, g, unknown or other
  misc_feature (478)..(478): n is a, c, g, or t
tcagacatacgcgtcacgaccggtgctcgatttagtacacacacttagggattgggggaggaactgctcagttaggacccagacggaaccatggaagcccagcgcagcttctcttcctctgctactntggctccagtttcagataccacgtggagaaatagngatgacgcagtctcacgccacctgtctgtgtcacgagggaanacgccacactcnccgtagcaggcagtcaggtcgtgttagccaggactagccgttacgcgtacggtaccagaccgaacgaacccgtggacccgacggccgtacccgacggtcctcctacaccttgtactcggtacgctacgtacgacgggaccggtacnccggttacgttaccgacccaggtaccgtaaggggtccgaaggtcgaacggtggttcgggaccgtggggaaactgggaccgtttacaacccggttctacccgtaacgtaccgtaacnccgggacggtaacgtccgtacgggaattcccgttaacgtaacggtaagtttacggtttaacctaggttttaacggttactttaacccggtgtaaccgggttaccaacgtttaaagttaccgtaaaaccgttccgggaccccggtttacggttaaacccggtttacgtttacccgggggttttaaggaccccggggttaacgggtaaaccgtaccggtaacccgggttaaggtaaaccgggtaacctaaaaccggtaaacggggtctttaaccgggtacgtacgttaacccgg

SEQ ID NO: 18106 - DNA, 735 bp, Homo sapiens
  misc_feature: GYAE6OF01BW3P3.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccacgcccaccctgtcttgtgtctccgaaggggaagacgccacactcctcctcgcgacgggccagtcagtgtgttacgcagcgagtcgttagccgtacgtaccagacgaacgaaccgtcggaccgacggcccgtacccgacggtaccttcccgtactacttccgttaacgtcggtcgtaccgtacgtacccggttaaccgggaccggtacccgtaccggtaccggttacctaccccgacggtaccgttcggttaccggtacggtcggtccggtaaggttcggggtacggtacgggtacgtacggttacgtttccgtaccttcgtaaccaaccttacgaccacggcccaacgtccggtcgacggtacgttagtacgtaaacgttttgtttacgtacgtttttacgtttaactttcgtcgtaaccgtacgttactaaacctttaacgttaaacgtacccggtccggttaacccgttacggttacgtttaccgggtttaccggaccggacggtacgaagttcggagtaacgtactaaccgaaggttactcggtcacgtccg

SEQ ID NO: 18107 - DNA, 785 bp, Homo sapiens
  misc_feature: GYAE6OF01BVBL8.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaaggggaaangccacactctccgtgcagggccagtccgagagtgttagcgtacgcgagtcttacgccgtaggtacccagaccaacggaaaccctcggaccgacgggtcccttaccccgacggtcccttcccgtacgtattcggtacgttggtaacgttcgtacccgtttaaccggaaaaaccggggtccctaacggtacgggacctaaccgtaccccgtaggtacccgttaagggttacccgtaggtcgggtacgtacgggttacggggttaccgtaggggtaaacgtaccgtaccgtttaccgtaaccttcctacccgtaaccctacgtaccaacggtaccgtaacgtaaccggacgtaccgtacggtaaccgttacgttcccgtagttactttacggttttaacgtaccttaggttacccgacggtacgtaaccgggttacccgtaaacccggttacggttccggtaccccgttccggtttaaccggtttccgggaacccgggtcgggggtaacccgtacgggtccggtacggacggtactaaccggacggtaacgtacggtcggtacgccggtacgtacccg

SEQ ID NO: 18108 - DNA, 735 bp, Homo sapiens
  misc_feature: GYAE6OF01AB8NF.22.59.F04.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (492)..(492): a, c, t, g, unknown or other
  misc_feature (492)..(492): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctcggcctcccagtttcagactaccactggagaaactagtgaatcgacgcagtcctccagcccaccctgtctgtcgtctcgaggggaaancgccactactcncctgcgacggcctagcagngttgtcgcagcacgtcgtacgtccgtacggtaccgtgaccgtaacgaaacccgtcggtaccacggcctcccggaggccttaccgtctacttcgtagtcggtcgactacgtacggtacggacggggtacctacggtcggtacctacccggagtaccgtacggttccgaggtcggaccgttagggtcggggtcgtacggtaacgtacggtacgttttccgacttcccgacgtaacgtaccgtacnccggtaccgtaccgtcctacggaccgttagttaccggtagtacgtttacggttacttacgttagtttacctacgttacgacggtacaccgttaattaacgtaactttacggtacccgtcgttaacccgttagtttaaccgggttccgggaaacccgttaacggggtacctaacgggtccgtaacgggtaaaccaggtttaaacccgaacggttaaacggttcgttaacccggggtctaaccgg

SEQ ID NO: 18109 - DNA, 699 bp, Homo sapiens
  misc_feature: GYAE6OF01CA4G0.22.59.F04.1.454.CMB.1.raw
  modified_base (584)..(584): a, c, t, g, unknown or other
  misc_feature (584)..(584): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtatccgaggggaaagcgaccacactctcctgcgaggccagtcgagtagtgttagcagcagtcttagccgtaggtaccgaagtacgaacgaaaccgtcggaccgacggcctcccgaggcctaccgtacacttaccgtagtcggtcactaacgtccgtacggacggtccctaacgtcggtaaccgcccgtaaggtccgtaacgggttcgaggttcggacgttagggtcgggttacgtcgggaacctaggtacgttacccgtactccgtaaccaccgtaactcgaacgtcctaacggtctcgtaccgtagtaccggttaagtaaacgtttcgttttaggacttttaacggttttataccgtgttaccaagttaccttaagtaaactacggttntaccgtttgtaccgttacaccgttaccggtacccgttacgggaaccaacgggtaccaacggggttaattaaccgggtaaacgttaaactaaaccgggtcgttcgggtaggtaccc

SEQ ID NO: 18110 - DNA, 801 bp, Homo sapiens
  misc_feature: GYAE6OF01CILKS.22.59.F04.1.454.CMB.1.raw
  modified_base (162)..(162): a, c, t, g, unknown or other
  misc_feature (162)..(162): n is a, c, g, or t
  modified_base (379)..(379): a, c, t, g, unknown or other
  misc_feature (379)..(379): n is a, c, g, or t
  modified_base (748)..(748): a, c, t, g, unknown or other
  misc_feature (748)..(748): n is a, c, g, or t
tcagacatacgcgtcacgaccggtgctcgatttagtacacacacttagggattgggggaggaactgctcagttaggacccagacggaaccatggaagccccagcgcagcttctcttcctcctgcctactcgtggcctcccagtttcagactaccacgtgganaaatagtgatgacgcagtctccagccctaccctggtctgtcgtcctacggaaggggaaacgcgcccaactaccttcctccgtggccgacgggccagtcgagtgtagtagcagcagtctaacggccgtaggtaaccaggtaccaaacggaacccgtcggaccgtacggcccctacccggacggtcctacccgtacgtaacttccgtaggttcggtacnccgtacgttcccggaacgggtaccgggtaccctacgggttaccggtaccctacccggtacggtacccggtacgggttaccgaacggggtcggtacggtggggttaggggtccgtaggggacgtaggttaccgttctaccctaccgtcctaactacgtccgaacggtacgtcccgccgttgacgttacgtaacggttaagtaagttttccttacggttacgtttaacgttttataacgtcggtaactaccgtaaacgttaattaaacgttaccgttaccggtcccgtaacccggtttaccgtaaggttcccgggttaacccgggaacgggttaacccggaaaccgttcgggttacgtaaaccgggtaaanaaaccccgttaaagggaacccggtaagtttcccggggtaagtaccccgtacgg

SEQ ID NO: 18111 - DNA, 680 bp, Homo sapiens
  misc_feature: GYAE6OF01CGMJY.22.59.F04.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (560)..(560): a, c, t, g, unknown or other
  misc_feature (560)..(560): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (672)..(672): a, c, t, g, unknown or other
  misc_feature (672)..(672): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagttcagataccactggaagaaatgtgatgacgcagtctccagcccacctgtctgtgtctaccgaggggaancgaccactactcctccngcgacggcctaggtcgagtagttgtagccgagcgtacgtcgtttacgccggttacggtaaccacgaccaacggtaaacccgtgggaccccgtacggtccctacccgaagggtccccttaccttcgtacgttaccttaggtggtacgaccgtacgtttaccgacgggaccgtcccgtaagttccggtaacctccccgaagtccgtaaggttccgagggtcggacgtaggtcggggtccggtaggaacgtacggttcttcccgtacgtcccttacgaccctagtacgacgtaccggaacgtcccgtagtacgtacgttacgtaaggttaacgtttntttacgtacgttagttttactcgtactacgtacacttaactacgtaaactcgtacgtcctcggttattagttccggacgacgtacnggtncggtaancgtaaacgagacgtnggccctag

SEQ ID NO: 18112 - DNA, 750 bp, Homo sapiens
  misc_feature: GYAE6OF01C36Y7.22.59.F04.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
tcagacatacgcgtcacgaccggtgctcgatttagtacacacacttagggattgggggaggaactgctcagttaggacccagacggaacatggaagccccagcgcagcttctcttcctcctgctactctggctccctagtttcagactaccacgtggaagaaatagtgatcgacgcagtcctccagccaccctgtctgtcgtctcgaaggggaangccacacgtcctccgtcgcgacggtccagtcaggagttgtancagactagtcttagcctaggtaccagacaaacgaacctcggaccaggcccctaccgcggtcctcctcgtacttcgtagtcggtacacgtactacgtacggaccggaccgtaccggtagtacctcccgacggtaccggtacggtttacggacgtacgggtacgtagggttacggggtccggtagggaacgtacggtacggttttaccacgttaccctacgtaaccctacggtaccgtaccgggacctaccgggtcctacggtacgtaccggtacgttacggtaaacgtttacgtttttaccggttaacgtttacgggtttttaaacctttcggttagtaccctaacgttaaccttaacgttaaacgttaacgttaaccggttaccgtaccgtttaaccgtaacggtttacgggttaccggacccggtaacggtaaccggtaggtccgtaacgggacgttaaacgtacgtaaaccgtgttacggcgtccgtaccg

SEQ ID NO: 18113 - DNA, 740 bp, Homo sapiens
  misc_feature: GYAE6OF01C4BF9.22.59.F04.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctccctagtttcagactaccactggaagaaatagtgatcgacgcagtctaccagcccaccctgtctgtcgtcctaccgaaggggaaancgacctacaccttcnccgtgaccgacggccagtcagacgtgtagcagacagtcctacgccgtacgtaccagtaccaacggtaaccgtgacccgaggtccctccggaacgtcctacctacgtaactcgtagtggtacgactagtaccgtaacgcggtacctaacgtcgtacctcccggaactcggtaggttaccgagggtcggacctaggggtcgggtacgtacgggaactacggtacttacgtaccgtacctaccgaccgtactacgaacgacgtaccgtacgtacgtacgaacgttccggtaagtaacgtttacgtttaggtaacgtttaacttaacgtttacggtcgttaacgtacggttaacctaatttaaccgttaaacgttacccgttaggttaccccgttaaccggttaaccgttgggttaacccgggaaccggtaaccgggtaacttacgggtccgtaaggaaaccgtaaacgtaaacgttaaaacgccggtaggttacggaccggtaaccg

SEQ ID NO: 18114 - DNA, 696 bp, Homo sapiens
  misc_feature: GYAE6OF01ALUYZ.22.59.F04.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (497)..(497): a, c, t, g, unknown or other
  misc_feature (497)..(497): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagactaccactggaagaaatagtgatgacgcagtctccgacgcccaccctgtccttgtcgtcctaccgaagggggaaacncgccacaccttctcctgacgacgggccaggtacgaggtagttcgtagcagcacgtctacgcctaggaaccngaccaagaacccgtggacccgacggtcccctcccggacggtcctaccgtcaccttgtacggtggtcnctacgttccgacggaccggtcctacggtcgtacctacccggacgtaccgtacgggtacgacggtcggtagtacgggttcgggacgtaggggtaccaggttaccgttcaccgtcctaccgactacgtacgcgtacncggtacctcgacgtagtacgttaggtactttagttcgttaactttacgtttatacgtgtaacctataaccgtattaaacgtacgttaccggttaccgtacccgttacggttagttccgggtttaccggaacgggtaccgggtaactacgggtcgtaggaactaacggtaaacttacggacggtttcggtcgtagtaccg

SEQ ID NO: 18115 - DNA, 789 bp, Homo sapiens
  misc_feature: GYAE6OF01B7DH7.22.59.F04.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagtaaatagtgatgacgcagtctccagccaccctgtctgtntctccgagggaanagccacactctcctgcaggccagtcgagtagtgttagcagcagtcttagcgtaggtaccagacaagaaccgtcggaccagggcccctccgaggtcctacctcacttcgtagtggtcgactactccgtacggacgggtacctacgttaccggtaacctcccgaacggtacccgtaggggtttaccgaacggggttcgggaccgggttaagggttccgggggtttaccggtaagggggtaacctaacgggttaacggtttccctaaccgttaccctacccgtaacccgtaacgtccgaagaccccggtagtccccgttacgaccggttacggttcgtaagtaaaccggtttacgttttaccgggtactttaacggttttacgtttactcggtttacgaagttaccgtaaacttaacgttaaacgtaaccgtttcgggaacccctttaccgggttaacgtttacgggtttcccgggaaaccggtaaccggggtaaccctaacggggttccggtacgggttaaacctaaccggttaaccggaaaacccggttaccgggttagggttccgggtaacccggtacgg

SEQ ID NO: 18116 - DNA, 820 bp, Homo sapiens
  misc_feature: GYAE6OF01BIEQR.22.59.F04.1.454.CMB.1.raw
tcagacatacgcgtcacgaccggtgctcgatttagtacacacacttagggattgggggaggaactgctcagttaggacccagagggaaccatggaagccccagctcagcttctcttcctcctgctactctgcctcccagagaccaccggagaagttgtgttgacacagtttccagccacccttgtctttgtctccaggagagccggccacctctcctgcaggccaatgagagtatagcgactacttagcctaggtaccaacgagacggccgtcggccgaaggccctcccgacggccttcccgtcaacgttcggttaactggagttcgtaccgttaaccgaaaacggggtcccgtaccgttaggccctacttaccccgacggtacccgtaggttaccaacgggtcggaccgtagggttcgggtacttacggggaaacgacggtaccgttaccgtaaccttaccgtaccccaacctatacccgaaaacgtaccgttaccgtaacggtaccgtaccggttaccggtaaaccgttacgtttaccgtaccggtaacgtttaacgttttacgtttaactttacgggtacctaaccgtaccgtaacggtacccgtaaccgtaaccggtacccggttacccgtttcccgggttaaccgtttttcccggggaaccccggttacggggtaacccgtaacgggccgttaacgggtacggtaacggttaccgaaacggttaaccggttacgggttacggtacgggtacccgtacgtcccgaaaccgttcttaaccggtttccgtttaccgttccgttaacccgttacccccg

SEQ ID NO: 18117 - DNA, 812 bp, Homo sapiens
  misc_feature: GYAE6OF01AZTJ2.22.59.F04.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctggctacccagtttcagataccactggaagaaactagtgatagacgcagtctccagcccaccctgtctgtntcncgagggaagcgccacactcncctgcgaggccagtcagagtgtancagcagtcttagcctacgtaccgagacaacgtaaccgtcggcccacggtccctaccccggaggtccctccgtctacttaccgttagttgggtaccgacttacgtccgtaccgggacggtacccttaacggtacggtacccgttacccgacggtccgttaacggttccgaggtccggcggttacgggtcggtacggtacgggactacggttacgttccctacgttaccgtccaaccgtactcgacgtccgtacggtaccctggtaaccctggttacgttaaccgttaaagtttcggtttttacctaacggtttttaacggttttttaaccttaacggttcccgtttacggtaaacccttaaccgttaaacttaaaaccggtttaacgtttaaccccggtaccgggtttacccttaaacccgggttttaccggtttacgggtttaccccgggggaaacccggttacccgggggaacccgttaacgggttaccgggacgggttaaaagtacggttaaaacccgtaaaccggttaggttagggttaaacccggccggtttaaacccgg

SEQ ID NO: 18118 - DNA, 717 bp, Homo sapiens
  misc_feature: GYAE6OF01D0NRV.22.59.F04.1.454.CMB.1.raw
tcagacatacgcgtcacgaccggtgctcgatttagtacacacacttagggagttgggggaggaactgctcagttaggacccagacggaaccatggaagccccagcgcagccttctcttcctcctgctactctgctcccagtttcagactaccactggagaaatagtgatgacgcagtcctccagcccacccgtgtcctgtacgtcctaccggaaggggtaaacacgcccaacgactcctccgtgacgacgggtccagtcgagtacgtacgttaggcagcagtccgttagccgtacgaccacgacaacgtaaaccgtcggaccgacggcctcccgaggtcctcctacatccgtaagtcggtcactacgttacgacgggacggtccctacggttacgtaccgcccgaacggtccgtaaggttcgagggtacggacgtcgggtacgggtcgtacgggaacgtaaggtcgttaacctcgttcctaaccgacctgtacacgtacgtcgtacgtggaccgttacgtacgtagtaagtttagtttcgtactttaacgttacgttcttacggtaccaggttaaccgtaactttaataaccggttaccgttccggtaacccgttacggttaaccggttaggttacccgggacggtaaccgggtacctaagggcggttaaaggacctaacgttaaccggtaaacgttagccgggttcgaccgtacgg

SEQ ID NO: 18119 - DNA, 711 bp, Homo sapiens
  misc_feature: GYAE6OF01AGW1P.22.59.F04.1.454.CMB.1.raw
  modified_base (181)..(181): a, c, t, g, unknown or other
  misc_feature (181)..(181): n is a, c, g, or t
  modified_base (213)..(213): a, c, t, g, unknown or other
  misc_feature (213)..(213): n is a, c, g, or t
  modified_base (345)..(345): a, c, t, g, unknown or other
  misc_feature (345)..(345): n is a, c, g, or t
  modified_base (378)..(378): a, c, t, g, unknown or other
  misc_feature (378)..(378): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggcctcccagtttcagactaccactggaagaaatagtgatgacgcagtcnccagccacctgtctgtctcgtcgaggggaaancgaccactactctcctgcgaggccagtcagtgttgtagctagctagcttacgcctggtaccagaccaacggaaccgtcggaccgacggtcctacccggacggtccttccgtacacgttctaggtggctaacncttaccggacgacgggtccctagtacggtaccnccctaggtaccgtaggttcacggtcgggacgtacgggtcgggtaccgtagggattacgtacttaccgtacttccggaacctaccgtagtaccgacgtacgacggtccctaggtactacgttacgtaagtacgttttaatttcggtaaacttttacggggtttaactacgttacgtactaactccgttaaaattaaccgttacggtaacccggttccgacgtttaccggttaaacgttgggttaacccggaccgggttaaccgggaacgtaacgttcgggaaggtaacgttaacgtaaacccggtaagtaccgtttagggcccgtaacttccgg

SEQ ID NO: 18120 - DNA, 804 bp, Homo sapiens
  misc_feature: GYAE6OF01A68G1.22.59.F04.1.454.CMB.1.raw
  modified_base (163)..(163): a, c, t, g, unknown or other
  misc_feature (163)..(163): n is a, c, g, or t
tcagacatacgcgtcacgaccggtgctcgatttagtacacacacttagggattgggggaggaactgctcagttaggacccaggacggaaccatggaacgccccagcgcagtcttctcttcctcctgctactctggcctccctagtttcagataccagtggaanaatagtgagtgacgctagtcctccgagtcccctacctgttacgttgtcgtccgtaccggaaagggaacgcgaccactcctctccaggcgaccggacgagtcgtagtagttacgtacacgagtactacggtcgtacggtccgtaacggtaccaacggaaccgtaaacggtaacccgtccgggaacccgacggtaccccgttaccggtaccggtaccttccgttacttaacgttcgttagggtccgtcgtaaccttaacgtcgggtaccgggtaccggtccgtacgttttacccggacccgtaaccgtacggtacgggttaaggttcggacggtcgggttcggtaacgggtgggtacggacgggtaattcgtacgtaccctccgtaactaccgtaccgtcgtacgacgtacgcgtacgtagtaccgtacgtagttacgttattacgtttacgttacgtttaacgttacgttcgtctaacgttcaaacgttttactaacggtttaacgtacccggttaccttaaccggtttaccgttaaccggtttcgggtaccgggtaaaccggtaacgggttacgtacggtaacggttagaaaacttacggtaaaccggtacggtaccggttaggtaccggtcgtaaacccg

SEQ ID NO: 18121 - DNA, 765 bp, Homo sapiens
  misc_feature: GYAE6OF01E00CA.22.59.F04.1.454.CMB.1.raw
  modified_base (459)..(459): a, c, t, g, unknown or other
  misc_feature (459)..(459): n is a, c, g, or t
  modified_base (625)..(625): a, c, t, g, unknown or other
  misc_feature (625)..(625): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggaagaaataggtgatggacgctagtcctccaacgccctaccctgtctgttacgtctaccggaaggggaacgacgccaactcgttcctcctggcgacgggtccaagtcgtaagtacggtgttagcacggtcacggtcttaacggcccgtacggtaccgacgacgaaacggtaacccgtggacccgacggtcccttcccggacggtccttcccgtactaacgttccgttaggtcggttccgacttacgtaccggttaacggaccggtccaggttaccgtacctaccgccggtacgtacggttacgngttcgggtagtcggggttcggtacggacggtagtagttccgttacgaaccgtcctaacgtacgtactacgacttaccgccgttcgacgtcggttaaccgtacggttaacggttaagttttacgttttagttaaccgtttaaggttttaccttacgttccggttaanaccgtacgttaactaactacgttaccgtaccgggttacctaccggtttacgttaggtttacccgggacgggtaaacgtacaaacgggttcgtacggaaagtaaccgtaacgtaaaccggtagcggttagcggttaaaccg

SEQ ID NO: 18122 - DNA, 858 bp, Homo sapiens
  misc_feature: GYAE6OF01AV60E.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgaatggacgcagttcctaccgacgtccctaccctggttcctggttcgtccgtaccggaagggggaaaacgacggaccaacgtacctcctaccgtggcgacgggtccaggtcgaaggtacgtaggttacgcgaacgcgtacgtacgttacgtccgttacggtaccgtaaggaccgtaaaccggaaacccgtacgggacccgtaacggggtcccctaccccgggaaccgggtacccttacccgttacgttaaaccgttcggtttaacggttacgggttacgaccgttaacgtacggtaaccgggtaccggggtaccctaccggttacggtacccggtacccgtaacgtacccggtaacgggttaccgtagggttacgggcggtacggggtacggggttccggtaagggggaaccgttacgggttaaccggtacccgttaccgttaccgttaaccctaaccggtacgtaaccggaccgtaacccgtaccgtaccggtcgaacggttaacgtaccgtaaggttaacgtttagttacccgtagtttaacgtttacgttacgttagtacgtacctaacgtaacttaacttaacgtacgtaccgtaccgttacgttacggttcgttacgggaccggtacggtaaccgaggttacggacgtaacgtaacgtaaccgtaacggttaacgcggtgtacgtcgg

SEQ ID NO: 18123 - DNA, 670 bp, Homo sapiens
  misc_feature: GYAE6OF01CEMTK.22.59.F04.1.454.CMB.1.raw
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggagaaatagtgatggacgcagtctccagccaccctgtctgtgtctccgaggggaagacgccacactctcctgcgaggcaagtcaagngtgttacgcagcagcttacgctgtacagacacgaaacgtcggccaggcctcccgaggtcctaccctnacttcgtagtcggtgactacgtacgtacggacggacctacgtacgacgtcccgaggcgtacggttacgaggtcgggcgtaggtcggggtcgtacggggactaggtcttcaccgttacacccgtaaccgacgttacacggacctaacgtcggtagccgttacgtacgttacggtaacgtttcggtttaacgtagtttaacgttttacgttacggtacggttcaacgtacccgtaattaaacgttaactaaccggttcgtaccgttaccgttaacggtttgttccgggaaccggtacgggaaccgttaaaggtcgtagggtaacgtaacgttaaaccaaggttagtcggtgggtacgtaccgg

SEQ ID NO: 18124 - DNA, 894 bp, Homo sapiens
  misc_feature: GYAE6OF01CIC16.22.59.F04.1.454.CMB.1.raw
  modified_base (248)..(248): a, c, t, g, unknown or other
  misc_feature (248)..(248): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctcggcctccctagtttcagactaccagtaggaagaaagtggtgagtacggaccgtcacgttccaccgacgcccctacccgtgtcgtcggttcgttccgaaccgggaaagggggaaacnccgacccaacctaccgttccttaccggaccggacgggccagtacgaggtagtgtacgcgacgtacgtacgtcgttaacgccggtacggtaaccaacggtaaccgaacggtaaacccggtcggccccggacggtacccccgttaccccggaaccggtcccttaccctacgtacgtttacgttaggtccggttacttacccgttacccgtaaccgggtaccgggtacccgttaacggttaccgtacccgtaccccgtacggttacccggttaggggtttacccgacggttcgggaacggttcgggggttcgggtacggtaaccggggtacgtaaggttcccggtacctaccgttacccacccgttacgactaccgtaccgtaccgtacccgtcacggtaccgtaggttacgtaaggtttaacggtttactttcgtaacggttttatttacgtacgtacgttacgtaacctacgtttaaactaacgtttaaaccgtcggtttacccttacccggtttcggttaaaccggttttccgggtaaccgggtaccggaacggggttaacccagggtaaccggttaacggtaaacgaaacccggtttaacggtaacccggtggtttaaccgggccgttaaccgttccggtaaacc

SEQ ID NO: 18125 - DNA, 727 bp, Homo sapiens
  misc_feature: GYAE6OF01A31DX.22.59.F04.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (556)..(556): a, c, t, g, unknown or other
  misc_feature (556)..(556): n is a, c, g, or t
  modified_base (722)..(722): a, c, t, g, unknown or other
  misc_feature (722)..(722): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagactaccactggagaaatagtgatggacgcagtctccagcccaccctgtccttgtcgtcctaccgaaggggaaancgccacacctcctcgtgccgagggccagtcagagtgtagcagcngtacgtacgccgtaggtacccagaccaacgtaaaccgtggacccgacggtcccctacccggaggcccttaccgtctaacttccgtagttcggtcgtacctaccgttaccgtaaccgggacggtacccctaacgttcggttaaccgcccccgtaaggtcccgttacgggttaccgaggttcggaccggtagggttcgggtcgtaggggaactcggactttaccgcctacctaccgaacctacgccgtacgtcgaccgtcctcgtacgtagtccgtaggtaacgtttacgtttnaccgttttaatttccgtagttcgaaccgtagtaccttaacgttaaacttaagttacccgttacggtacccttacggttacctttgggttaacccggacggttaaaccgggaccctaagggtccggtaacgtaggtaaaccgaacgtaaacgtacgtcggtccggtntaccg

SEQ ID NO: 18126 - DNA, 703 bp, Homo sapiens
  misc_feature: GYAE6OF01EYAIH.22.59.F04.1.454.CMB.1.raw
  modified_base (211)..(211): a, c, t, g, unknown or other
  misc_feature (211)..(211): n is a, c, g, or t
  modified_base (323)..(323): a, c, t, g, unknown or other
  misc_feature (323)..(323): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaangccacactctcctgcgaggccagtcagagtgtagcagcagcttagccgtaggtaccagacaacgaaaccgtggacccaggcctacccgaggcctccgtcatcgtagtcggtnactattaccgtacggacgggccctagtcggtacctcccgaggtcccgtaagggttccgaggtcgggaccgtagggttcgggtacgtagggacctaggtacgttccaccgtcgtacctacctataccgacgaccacgccgtgaccgtacgtcgtaacgtaacgttacttttacggtactttaacgttttacttaacgtgttacgtaacgtaccttaaacgttaaattaaaccgttaaccggttcggtaaccccgttaccggttaaccgtttacggttttaaccgggacccggtaaccggggtaacctaacgggttccgtaagggtaactaacggtaaaccgtaaaccggtaacggttacggtaccgggtacgttaacccgg

SEQ ID NO: 18127 - DNA, 764 bp, Homo sapiens
  misc_feature: GYAE6OF01DNESW.22.59.F04.1.454.CMB.1.raw
  modified_base (211)..(211): a, c, t, g, unknown or other
  misc_feature (211)..(211): n is a, c, g, or t
tcagacatacgcgtcacgaccggtgctcgatttagtacacacacttagggatgggggaggaactgctcagttaggacccagacggaaccatggaagccccagcgcagcttctcttcctcctgctactctggctccctagtttcagataccactggagaaatgtgatgacgcagtctccagccaccctgtctgtcgtcctcgaaggggaaancgccactactctcctgccgaggccagtcgagaggttgtagcgacgactagtacgttacgccgtaggtaccaggacaacgaaccgtcggaccacggccctaccgacggtccttccgactatcgtagtcggtacgtactaacgtccgtaacggacggtacccctaaggttccgtacgtaccccgaaggtcccgtaagggttccgtaagggtaccggtcggtaacggttcggggtccgtaggggaacctagttaaccgttcgaccctcgtaacccaccgtaacgtccgaacggaccccgtacggtcccgtacggtaccgtacgttaccgtaaggtttaagtttcggttttaccggtaacgtttacgttttaaccgtaggtaccgtacgtaacttaccgttaacgttaaacttaagttacccgttcggtaacccgtttaccgttacggttaccggtttcccgggaaccggtaaacggggtaaccctaacgggtccgtaaacgggtacgaaaccgttaacccggtaaaacggtacgttacggtccgtacgtaccccgg

SEQ ID NO: 18128 - DNA, 728 bp, Homo sapiens
  misc_feature: GYAE6OF01B3IGH.22.59.F04.1.454.CMB.1.raw
  modified_base (214)..(214): a, c, t, g, unknown or other
  misc_feature (214)..(214): n is a, c, g, or t
  modified_base (667)..(667): a, c, t, g, unknown or other
  misc_feature (667)..(667): n is a, c, g, or t
  modified_base (708)..(708): a, c, t, g, unknown or other
  misc_feature (708)..(708): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagactaccacgtggataaatacgtgatgacgcagtctcagcccaccctgtctgtcgtctccgaagggaacngccacgtactcgtacctgcgacggccagtcgagtacgtgttacgcacgctagtcgtaacgcgttacggaccagaccgtaacgaaccgtcggaccgtaacggtcccctacccggacgggtcccttaccgtacgtaacgttcgtacggttacggtcgtaccgtacgtaccgtaacgggtacccgggtacctaacgttccggtaaccgttccccgaaggttacccggtacggttccgaacgggtggtaaccgtacgggtacgggttaccgtacggggtaactaacggttacgttaccaccgtttccgaaccgtacacgtacgacgtacgtacgtccgtagaccgtatacggtagtacgttcgttgtacttagtttactcgtagtacacgttactaacgtacttacgaccgttagtcccgttacgtacgttccggttacgggaacggtccgggtaanacggtttccgaggtaaccgtaaccgttaccgtaaacggttnttacggtcgtaccgttaccg

SEQ ID NO: 18129 - DNA, 917 bp, Homo sapiens
  misc_feature: GYAE6OF01DY5HJ.22.59.F04.1.454.CMB.1.raw
  modified_base (218)..(218): a, c, t, g, unknown or other
  misc_feature (218)..(218): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggcctcccagtttcagataccactgggaagaaatgtgatggacgcagtctccacgcccacctgtctgtcgtctaccgaagggaaacncgcccactacctctcctagcgacgggccagtccgaggtagtgttacgcacgacgtaggtaccttaggcccgttacgggaaccaacggtaccaaacggtaaacccgtcggacccgtaccggccccgttaacccgcgtcccgttacccgtacgaactttccgtacgtttcgggtaccacttaccgttacggacggtaccggggaccttaggtaccgtaccgccccgaggtacccgttacgggttcgaggtcgggtcgtaacggggttcggggtacgtaccgggtaacgtacggttaccgttacccgtaccgttacctaccgtaacccgtacgtaccgggtacggtaaacccgtaccggttaccgtacgtaccgttaaccggttacggtttacggttaaacggttttcggtttttaccgtaacggtttttaacgttttaaccgtttacggtttacgttaaccggttaaccttaaccggtttaaaccttttaaaagttaaacccgggtttaacgttacccgggtttaacccgtttacccgggttaaaccgggttttacggggttaacccgggtaccccgggtaaaccgggggttaaacccccggttaaacgggttccgggttaaaaccggtacggggttaaaacccttaaccggttaaaacccggggttaagtttacccgggacgggttaactaaccccgggg

SEQ ID NO: 18130 - DNA, 594 bp, Homo sapiens
  misc_feature: GYAE6OF01D8NFR.22.59.F04.1.454.CMB.1.raw
  modified_base (210)..(210): a, c, t, g, unknown or other
  misc_feature (210)..(210): n is a, c, g, or t
  modified_base (313)..(313): a, c, t, g, unknown or other
  misc_feature (313)..(313): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagtcgttagccgtggtaccagcaacgaaacccgtcggacccagggcctcccgagggcctccctnacttctagtgggtcgactagtccgtaggacggccacgtggtactcccagtccgaggttcaggtcgcgtaggtcggggtctgggactaggtacgttccatcctcaccagtcagcacgtctgctagtctagtagtgtttgacgttagttttatactgtagacgtactacgtttaataacgtacgtacgtccgttaccgtagttacgtttacggaccggtaacgggacccgtaaggtcggtagggagtaaccgtacgtaaacggtacgttggtcgtccgtaccg

SEQ ID NO: 18131 - DNA, 850 bp, Homo sapiens
  misc_feature: GYAE6OF01E22TY.22.59.F04.1.454.CMB.1.raw
  modified_base (160)..(160): a, c, t, g, unknown or other
  misc_feature (160)..(160): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
tcagacatacgcgtcacgaccggtgctcgatttagtacacacacttagggattgggggaggaactgctcagttaggacccagacggaaccatggaacgccccagcgcagcttctcttcctcctgctactctggcctccagtttcagactaccactggaanaaatgtgatgacgcagtctccagcccacctgtctgtcgtctaccgaagggaancgccactctcnctgcgcggctagcagtagtgtacgcacgtcacgtcgttacgccgtacgtacacgacgaacgaaccgtcggaccgacgcccgtaccgtcgtcctcctacgtaccttagtacgtcggtcacgtacgttaaccggtacggaccggtcctaacggttcgtacccgtacccgacgtacggttacggttacggacgggtcggtacggttacggggttcggtaccgggtacgaacggttacgttccgttacctaccggttacccttaacccgaacgtccttaaccggacgtacccgttaacggtcccgtaacgggtaccgtaacggttacggtttaacgttaaacgtttttcgttacggttaactttttaacggttttacaaccggtttcgtaactaacggtttaaacccgttaaagtttaaaaccgttaccgttaacccgggttttccggttaacccgttttaaccggggttaacgtttttaaccgggggtacccgggaaaccggggggttaaacccggttaaacccggttagggtaacccgggttaaaccggttaaaacccgtaaaaccgggttaaacccggttaaacgggtttaacccggtttcggggtaaacgtccccggttaaacccg

SEQ ID NO: 18132 - DNA, 800 bp, Homo sapiens
  misc_feature: GYAE6OF01CPLRP.22.59.F04.1.454.CMB.1.raw
  modified_base (160)..(160): a, c, t, g, unknown or other
  misc_feature (160)..(160): n is a, c, g, or t
  modified_base (211)..(211): a, c, t, g, unknown or other
  misc_feature (211)..(211): n is a, c, g, or t
  modified_base (381)..(381): a, c, t, g, unknown or other
  misc_feature (381)..(381): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggctcccagtttcagactaccactggaanaaatagtgatgacgcagtctccagccacctgtctgtgtctacgaggggaancgccactactctccgtgcgacgggccagtcaggtagttggtacgcagacacgtctacgcctaggtaccagacctaacgaaccgtcggaccaggtccctaccgacggtcctcctcacttcgtacgtcggtacactacgtaccgtacggacggtacctacgttcggtaaccncccgtacggtccgtaggttaccgaggtcggtacggtcgggttcggggtcgtacgggtaactacgggttacttacccgtaccttccgtaacctaaccgttatacccggaacgtacccgaaccgggttccctaaggaccgttaggtttaccggttaacggttaaacgtttttaggttttacccgttaaccggtttttaacgtttttaaccgtttaccgttcgtaaaccctaaaggtttaacccttaaattttaaccgttaaacccggttaaccgggttcccgttaaccccggtttacgggttaaccgttttaaccgggtttccggggaaacccggaaccgggttacccgtaaagggttccggaacggtaaataaacccgttaaacggaaaccgttagggttaccggtgtacccgtaaccgg

SEQ ID NO: 18133 - DNA, 636 bp, Homo sapiens
  misc_feature: GYAE6OF01DR8GY.22.59.F04.1.454.CMB.1.raw
  modified_base (170)..(170): a, c, t, g, unknown or other
  misc_feature (170)..(170): n is a, c, g, or t
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (319)..(319): a, c, t, g, unknown or other
  misc_feature (319)..(319): n is a, c, g, or t
  modified_base (508)..(508): a, c, t, g, unknown or other
  misc_feature (508)..(508): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (627)..(627): a, c, t, g, unknown or other
  misc_feature (627)..(627): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccagtttcagataccactggagaaatagtgatgacnagtctcagccacctgtctgtgtctcgagggaanagccacactctctgcgaggccagtcagngtgtagcacgnagtcttacgcgtcggtaccacgcaacgaacctcggaccacggccctccgacggtccctactcgactctagtcggtcnctatcgaccggacggtcctagtcggttacacccgaggtaccgttaggtacgtgtcgggacgtcggttacggggtcggtaaacgggtaacgtcgttaccgtaacttcctaccgtacccataccgcggacgacgtccgtagtccgtacgttcgtaacggtaaacgttttcgtttagaccgtttttaagttntttaacgtcttagaacttacttaattaactaagttccgtccggtcgtttacccctaggtttacgttcggacccgacgggtaactacgnggtgaaancgtaaggtaacctagtgggtacncgtcgtaac

SEQ ID NO: 18134 - DNA, 707 bp, Homo sapiens
  misc_feature: GYAE6OF01BEWQR.22.59.F04.1.454.CMB.1.raw
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
  modified_base (206)..(206): a, c, t, g, unknown or other
  misc_feature (206)..(206): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccatgganaaatagtgatgacncagtctcagccaccctgtctgtgctcgaggggaaancgcacactctacctgcgagggccagtcagtagtgtagcagctagcttagccttaggaccagactacgaaaccgtggaccaggcctcccgaaggcctacctcactcgtatggtcgcctagttaccgaacggtacggtaccaacggttacggtaacctcccgaaggtaccccgtagggtttaccacggggttacggtacgtaacgggttcgggggtacctaacgggggtaaccaagggttaaccgtttaccgacccgtaccttaccgtaaccgtaacctacgaacgtacgaccgtaccgtacgtacgtacgttacgtacggtaaagtttacgttttcgtaacctttaaggttttaacttacgttacgtactacgtaactaaacttaacttaaacttacgtaccgtacttccgtaacgttcggtttacggaccggtacgggtaaccgtaaggtaccgtaggtaacgaaacgtaacgaaacgttaaggacggttcggtacgtacg

SEQ ID NO: 18135 - DNA, 797 bp, Homo sapiens
  misc_feature: GYAE6OF01EPXFG.22.59.F04.1.454.CMB.1.raw
  modified_base (161)..(161): a, c, t, g, unknown or other
  misc_feature (161)..(161): n is a, c, g, or t
  modified_base (224)..(224): a, c, t, g, unknown or other
  misc_feature (224)..(224): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctccctagtttcagatacccataggaanaaatagtcgatgacgcagtcctaccacgccctaccctgtctgtcgtccgtacggaagggaaancgccctaactacctcctccgtcgacgacgggccaaggtaccaggtacgttgtacgcagcgacgtcttacggcccttaggtacccaagaccgtaaacgaaccgtacggcccgtacgtaccccgtcccgtacggcccttaccgtactccgttacgttagtcggtacgtccgtactacggtaccggaccggtcctaacggttccgacctacccgacggtccgttaggttacgtaggtcggtacggttaggggtcggttaccgggtagggacgtacgtaccgttctaccctcgtaactccctacgtacgaccgtccgtaacgtccgtacggtccctaaggttacccggtttaagtaaccgttttacgttttcggttaaactttttaacggttttacctttaacggttccgtacgtaaccgttacgttaaaactttaaccgttaacggttaacccgttaaccggtttcccgtaaaccgtttacgggtttacggttcccgggtaaaccggtaaccgggtccgttaaggcgtaacgaagttaaccgtaacggtaacggtaggttcgtacggtctacccgg

SEQ ID NO: 18136 - DNA, 724 bp, Homo sapiens
  misc_feature: GYAE6OF01C34QK.22.59.F04.1.454.CMB.1.raw
  modified_base (222)..(222): a, c, t, g, unknown or other
  misc_feature (222)..(222): n is a, c, g, or t
  modified_base (394)..(394): a, c, t, g, unknown or other
  misc_feature (394)..(394): n is a, c, g, or t
  modified_base (448)..(448): a, c, t, g, unknown or other
  misc_feature (448)..(448): n is a, c, g, or t
  modified_base (714)..(714): a, c, t, g, unknown or other
  misc_feature (714)..(714): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagactaccactggaagaaataggtgaatgacgcagtcctccagcccaccctgtctgtagtcctccggaaggggaaacncgaccactactctccgtgaccgacgggcctaagtcgaagtacgttgttagctagcgtaagtccttaacggccgtaggtaacccgaagaccgtaaacgtaaacccgttcgggacccgtaacggtccctcccggtaacggtcctacccgtataacgttcgtaggtcgggtaccntaacgtaccggtacggacgtcgtaccgtacggtaccaccggacgtcgtacggtnaccgggtgacgtacggtcgggtacgtcggaacgtaacgtccggttactaaccgtctaccgtacgtacgtacgtacggacccgtacgtcccgtggacccgttacgtacggtaccgttaaagtttccgtttacgtaagttttacgtttacgttaccgtacgtaactaccggtactaaacggttaaccttaaggtaacctccggtacttaccgtacgttaccgtaccgacggtaccggatacgtgacgtacctaactacgaacgtacgngtacgctacg

SEQ ID NO: 18137 - DNA, 748 bp, Homo sapiens
  misc_feature: GYAE6OF01B3V3Q.22.59.F04.1.454.CMB.1.raw
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (488)..(488): a, c, t, g, unknown or other
  misc_feature (488)..(488): n is a, c, g, or t
  modified_base (589)..(589): a, c, t, g, unknown or other
  misc_feature (589)..(589): n is a, c, g, or t
tcagacatacgcgtcacgaccggtgctcgatttagtacacacacttagggattggggggagaactgctcagttaggacccagaccgggaaccagtgggaacgccccaggaccgcagtcctttcgtcttcctccttgctactctggcctcccgtatttcagtactaccgattagggaagtaaatgtggaactcggacgctacgtcctaccgacgtcccctacctgttctagtcgttacctacggaaggggaacncnccgactacgttcctacgnggacgacggttaccaggtacgtaagtggttcgtaacgcgtacgagtacgtacgttaccgcggtacggtaccagtaccgaacggtaacgtcggaccgacggtacgttacccgacggtcctacgtacgtactacggtgttggcaccgtacttccggaggtccgaacttcggacgtcctacgagtaccggtgtacggacgtgcgtaacggtgggtacncgtagacgtcttacggaccttcgatacccgtgaccgtacacggacgtactgtacgtactaacggtcggtttaagttagttcgttattaacgtttacgttanacccgtttaagaaccgttagttaacttaacggttaacctacccgggtgttacccttaaaccggtagtttaccgggttaaccgacgggttaaccggacgaacggttcggaaaggttacaaaccggtaacggtaactgggtaccggtaatcggtaaacccg

SEQ ID NO: 18138 - DNA, 822 bp, Homo sapiens
  misc_feature: GYAE6OF01A5BO4.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggctcccagtttcagataccactggagaaatagtgatgacgcagtctcagccaccctgtctgtgtctccgaggggaaangccacactcctctagcgagggccagtccagtagtgttagcaggcagtcttagcctggtacccagcagaaccgtcggcctaaggccctacccgagggtcccttcccgtacgaacgttccgttaaggtcgggtttacgacctaacgtttccggttaacccggaacgggggtcccttaaccggttcgggttaacccgttacccccgaagggtacccctaagggggttttaccccaagggttcgggtaccgtaaacggggtttcgggggtacccgttacggggggaaacctagggttaaaccggtttcccaaccggttaccgtaaccgtaacccgtacctacgtaaccggtaccgtaccggtacccgtacggtaccgtacggttacccggtaaggttaaacgtttacgttttacggtaacgttttaacggttttaactttaacgttccggttaactaccggtaaccttaaaccgttaattaaaccgtaccgttaccggtccgttaccggttaaccgttacggtttaccggaccggttacgggtaaccgtacggtccgttacgggtaacttaacgtaccgtaaacggtaaccggttcggtccggtacgttacccggg

SEQ ID NO: 18139 - DNA, 789 bp, Homo sapiens
  misc_feature: GYAE6OF01BHU78.22.59.F04.1.454.CMB.1.raw
  modified_base (156)..(156): a, c, t, g, unknown or other
  misc_feature (156)..(156): n is a, c, g, or t
  modified_base (307)..(307): a, c, t, g, unknown or other
  misc_feature (307)..(307): n is a, c, g, or t
  modified_base (537)..(537): a, c, t, g, unknown or other
  misc_feature (537)..(537): n is a, c, g, or t
  modified_base (556)..(556): a, c, t, g, unknown or other
  misc_feature (556)..(556): n is a, c, g, or t
  modified_base (676)..(676): a, c, t, g, unknown or other
  misc_feature (676)..(676): n is a, c, g, or t
  modified_base (763)..(763): a, c, t, g, unknown or other
  misc_feature (763)..(763): n is a, c, g, or t
tcagacatacgcgtcacgaccggtgctcgatttagtacacacacttagggattgggggaggaactgctcagttaggacccagacggaaccatggaacgccccagcgcagcttctcttcctacctgctactcgtggcctccgagtttcagacttacncgtggaataaattcgtgagtcgacgctagtcctaccgagtccctacccgttgtcgttggtcgtaccgtaacgggaaggggaaacacgtacccaacgtccgttctaccggtcggacgacgggcctaggtaccgtaggtacgttagtaaccgntacggactacggttcctccggtaccgtacggtacctaacggtaacaacggttaaccgcggtccgacggtccccaccgtacggtccttaccaccgttatacgtgtaccggtctacgtcgtaaccggttcgggaccgtaccgttacgtaaccgtccgtaaccgtcgggtaccgtttaacggtcggaagtccggtaaggtcggttcgggtacggtcgaagtcgttaccggttnaaccggtcaccgtaccgancgactacgacgtcgaagtcctagtacgttaagtactttacgttacgtgtttaacgttaccgtagttcgaccgttacgtaaccttaacgtagttaacccgttgttacccgttaaccggttntttaaccggttccggtaaccgggtcgggttaaaccgtacggttacggtacgtaacgggttaccctaaaccgggtaactaacggttanaaccgggtttaccgccggtaaacccg

SEQ ID NO: 18140 - DNA, 495 bp, Homo sapiens
  misc_feature: GYAE6OF02GUR76.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctcccaggctcctcatctatggtgcatctacgagggccactggtatcccagccaggttcagtggcagtgggtctgggacagagttcactctcaccatcagcagcctgcagtctgagtatttgctagtttattactgtcagctactataataactgcctcgtactagtttggccgtagggaccagcgtaggagatacgaaacgactgtggctcg

SEQ ID NO: 18141 - DNA, 543 bp, Homo sapiens
  misc_feature: GYAE6OF02IMQHV.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaaacctggccaggctcccaggctcctcatctatggtgcatctacgagggccatggtatcccagccaggttcagtggcaggtgggtctgggacaggtagttcactctcaccatcagcacgcctgcagtctagaagtattttcgctagtttattacttgtacagctaactattaaacttaacgtcggtaccttccgttactacggttttcggaccgtaacggggtaccaaggtcgtaggagtacgtaacgaaaccgtacgtggtacggtactacgg

SEQ ID NO: 18142 - DNA, 559 bp, Homo sapiens
  misc_feature: GYAE6OF02IX75O.22.59.F04.1.454.CMB.1.raw
  modified_base (306)..(306): a, c, t, g, unknown or other
  misc_feature (306)..(306): n is a, c, g, or t
tcagacatacgcgtcacgaccggtgctcgatttagtacacacacttagggattgggggaggaactgctcagttaggacccagacggaaccatggaagccccagcgcagattctcttcctcctgctactctggctcccagtttcagataccactggagaaatagtgatgacgcagtctccagccaccctgtctgtgtctccaggggaaagagccacactctcctgcagggccagtcagagtgtagcagcagcttagcctggtaccagcagaaacctggccaggctcccaggctcctcatctatggtncatctacgagggccactggtactcccagccaggttcaggtggcaggtgggtctgggacaggagtttccactctcaccatcagcagcctgcacgtctagtaagtacttttgcttaagtttattactgttacagtcctaacttaattaaactaacgtcggtacccgttaccgtacgttacggttttcggaccgtaacggggaacctaaggtcgttaggagtacgtacaaaccggtacgtacggtacggtcgtacg

SEQ ID NO: 18143 - DNA, 494 bp, Homo sapiens
  misc_feature: GYAE6OF02FZ9H7.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcaaccctgtctgtgtctccaggggaaanagccacactctcctgcagggccagtcagagtgttagcagcagcttagcctggtaccagcagaaacctggccaggctcccaggctcctcatctatggtgcatctacgagggccactggtatcccagccaggttcagtggcaggtgggtctgggacagagttcactctcacatcagcagcctgcagtctgagtatttgctagtttattactgtacagtcactataatactgctcgtactagtttgcgtagggaccagtctggagacgtacgaacgacgtgtggctcg

SEQ ID NO: 18144 - DNA, 517 bp, Homo sapiens
  misc_feature: GYAE6OF02I2JCB.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggctcctcatctatggtgcatctacggagggccactggtactcccagccaggttcagtggcaggtgggtctgggacaggagttcactctcacatcagcagcctgcagtctagaagtatttgactagtttattactgtactagcactaataataactcgacctccgtactagtttcggaccgtagggaccaaggtcgtaggagagtacgaaacgtacgtggtaggctacg

SEQ ID NO: 18145 - DNA, 519 bp, Homo sapiens
  misc_feature: GYAE6OF02HTEIC.22.59.F04.1.454.CMB.1.raw
  modified_base (209)..(209): a, c, t, g, unknown or other
  misc_feature (209)..(209): n is a, c, g, or t
  modified_base (363)..(363): a, c, t, g, unknown or other
  misc_feature (363)..(363): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccaacagaggcctggccaggctcccaggctcctcatgtatgatgcttaccaaaagggccactggcatcccagccaggttcagtgcaggtgggtctggaagngacttcactctcaccatcaacacgcctagacgcctgacgattctgctagtttatacttgtcagcagcgtacgagtcggtcctccgtacgtttcggccgtacggggccgtaaggccgtaggacgacgtcgacggacgtaacgtggtcggcgtgaccg

SEQ ID NO: 18146 - DNA, 531 bp, Homo sapiens
  misc_feature: GYAE6OF02H1HI5.22.59.F04.1.454.CMB.1.raw
  modified_base (210)..(210): a, c, t, g, unknown or other
  misc_feature (210)..(210): n is a, c, g, or t
  modified_base (368)..(368): a, c, t, g, unknown or other
  misc_feature (368)..(368): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccagggggaaangccacactctcctgcagggccagtcagagtgttagcagcagcttagcctggtaccagcagaaacctggccaggcctccaggcctcctcatctatggtgcatctacgagggccacgtggtattccagccaggttcaggtggcaggtgggtctggggacnggtagttcactctcaccatcagcagcctgcagtctagaagtatttgctagtttattactgtacagtctactataataacgtcgtacctccgtactacgttttcggaccgtacgggacctaaggtcgtaggagtacgtacgaaacgtacgtagtacggtctacg

SEQ ID NO: 18147 - DNA, 567 bp, Homo sapiens
  misc_feature: GYAE6OF02F4WM6.22.59.F04.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcaagaaacctggccaggcctcccgaggcctcctcatctatggtncatctacgnggccagtggtactcccagccaggttcaggtgcaggtgggtctgggacaggtattcactctcaccatcagcacgcctgcagtctagaagtatttgacttagttttattacttgtactagtactacttaataacttaacgtacggtaccttaccgttaacgttacggttttacggaccggtaacggggaaccgtaacggtcgtagggtaacgtaacgtacgtaaaccggtaacgtcggtacggtacgtacg

SEQ ID NO: 18148 - DNA, 681 bp, Homo sapiens
  misc_feature: GYAE6OF02IWT2V.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctccgagggaagcgccacactctcctgcgacggccagtcagtagtagtagcagcagtcttacgccgtaggtaccagacgaacgtaaccgtcggaccgaggccctacccgaggtcccttcctactagtcgtatgatcgtccttaaccgaaacgggccacgtcggaccaccgtacccgacgaccgtacggttacagggtcggacgtagggttcgggtacgtagggaagacgtacctttcgacgttcctacgtaaccctactaccaacgtacgtaccgtaacggaccgtaccgtagtaaccgttacgtttcgtacgtaccgttaagttttaacttacgttcgtaccgacgtaccgtacgtacccgttaaccgtaacggttccggtacccgttaccgttacggtttccgggaccgggtaccggggtaccgtaacggtcgtacggacgtacgtacgaacggaccgtacgtcggtcggtcgtacgtaccg

SEQ ID NO: 18149 - DNA, 550 bp, Homo sapiens
  misc_feature: GYAE6OF02HRYAC.22.59.F04.1.454.CMB.1.raw
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggctctcatctatggtncatctacgagggccacgtggtactcccgagccaggttcaggtggcaggtgggtctggggacagagttcactctcaccatcagcagcctgacagtctagaagtattttgctagttttattactgtacagtctacttataaacttaacgtacgtaccttaccgtacgtacggttttcggacccgtaaggggtaccctaaggtccgttaggagtacgtacgaaacgtaacgtacggtcggactacgg

SEQ ID NO: 18150 - DNA, 493 bp, Homo sapiens
  misc_feature: GYAE6OF02IE3LT.22.59.F04.1.454.CMB.1.raw
  modified_base (209)..(209): a, c, t, g, unknown or other
  misc_feature (209)..(209): n is a, c, g, or t
  modified_base (325)..(325): a, c, t, g, unknown or other
  misc_feature (325)..(325): n is a, c, g, or t
  modified_base (490)..(490): a, c, t, g, unknown or other
  misc_feature (490)..(490): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggctcccaggctcctcatctatgtgcatctacgaggccatggtacncccagccaggttcagtcggcaggtgggtctggggacagagtttcactctcaccatcagcacgcctgcagtctgagtatttgctagtttatactgtcagctatataatactgcctacgtactagtttgcgagggaccagcgtaggagatacgaaacgtactgtcgntcg

SEQ ID NO: 18151 - DNA, 582 bp, Homo sapiens
  misc_feature: GYAE6OF02HLI89.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggcctccaggctcctcatctatggtgcatctacgagggccacgtggtactcccgagcctaggttcaggtggcaggtgggtctggggacagtagtttcactctcaccatcagcagcctgctagtctagtaagtattttgacttagtttattacgttgtacacgtacctaacttaattaaacttaacgtcggtacccttacccgttacgttacggttttacggacccggtaacggggtacccgtaaacggtcgtacgggaacgtacgtaaccgtaaaaccgtaacgttaggtacggtacgtacgg

SEQ ID NO: 18152 - DNA, 635 bp, Homo sapiens
  misc_feature: GYAE6OF02IKZYB.22.59.F04.1.454.CMB.1.raw
  modified_base (216)..(216): a, c, t, g, unknown or other
  misc_feature (216)..(216): n is a, c, g, or t
tcagacatacgcgtcacgaccggtgctcgatttagtacacacacttagggattgggggaggaactggctcagttaggacccagacggaaccatggaagaccccagccgcgagcttctcttcctcctgctactctggctcccagtttcagtactacctactggagaaatagtgatgacgcagtctccagccaccctgtctgtgtctccaggggaagnggccacacgtctacctgcagggcccaggtccagagtgttagcagcagcttagcctggtaccagcagaacctggcctaggtctcccaggcctccgtccagtgtagtgtatgtcgttacccgaaaaggggccgaactggacactcccacgtccgtaggttccagtcggactaggtgggtctagggaagtacgacgttcactctccaccataccaacgagacctagacgacctagacgtacttctgtcgtaagttttacttacgtcgttcaaggtcctaaggtaccgtaaccgaaacgttcgggtaccttaccccggtacgttttccgggaccgtacgggggtaccctaagggtccgtagggtacggtacgtacggtaacggtaccggtaaccgttcggtacggtaccgttcggtaaccccg

SEQ ID NO: 18153 - DNA, 517 bp, Homo sapiens
  misc_feature: GYAE6OF02FJ7CI.22.59.F04.1.454.CMB.1.raw
  modified_base (408)..(408): a, c, t, g, unknown or other
  misc_feature (408)..(408): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggctcctcatctatggtgcatctacgagggccactggtactcccgagcccaggttcagtggcaggtgggtctggggacaggagttcactctcaccatcagcagcctgcagtctagaagtntttgctagtttattactgtcagctactattaataactcgtccttaccgtactagtttcggaccgtagggacctaagcgtaggagatacgaaacgtacgtggtggctcgg

SEQ ID NO: 18154 - DNA, 670 bp, Homo sapiens
  misc_feature: GYAE6OF02ITTIO.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaaacctggccaggctcccaggcctcctacacttctagtggtgactactcgtaacggagggccctaacgtggtactccccgaggcccaagggtttccaggtggactagggtcgggttcaggggacaggtacggtttaccacgttaccctacgaacccacgttaccgaacggtaccgaacgtcccgttaggaccgtacggtacgttacggtaaagttagttttacgacgttaaggttttaacttaacgtcgttactagtacctaacgttaactaaacgttaactcgggtacccttacgttaacgtacggttttaccggaaccggtaacggggtaaacccgtaaggtaccgtagggtaacgacgttaacccgtaaacggtaacgttggtacggtcgtaacgg

SEQ ID NO: 18155 - DNA, 504 bp, Homo sapiens
  misc_feature: GYAE6OF02HBUPA.22.59.F04.1.454.CMB.1.raw
  modified_base (210)..(210): a, c, t, g, unknown or other
  misc_feature (210)..(210): n is a, c, g, or t
  modified_base (500)..(500): a, c, t, g, unknown or other
  misc_feature (500)..(500): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccagggggaaangccacactctcctgcagggccagtcagagtgttagcagcagcttagcctggtaccagcagaaacctggccaggctccaggctcctcatctatggtgcatctacgagggccactggtatcccagccaggttcagtgcagtggtctggggacagagttcactctcaccatcagcagcctgcagtctgagtatttgctagtttattactgtcagcactataataactgcctccgtactagttttggccggacgggacaacgtgtaggagtatacgaaacgtaacgtagtcggntacg

SEQ ID NO: 18156 - DNA, 533 bp, Homo sapiens
  misc_feature: GYAE6OF02GS6N3.22.59.F04.1.454.CMB.1.raw
  modified_base (529)..(529): a, c, t, g, unknown or other
  misc_feature (529)..(529): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctccaggctcctcatctatggtgcatctacggagggcccagtggtactcccagccaggttcaggtcggcaggtgggtctgggacaggagttcactctcaccatcagcacgctgcagtctagaagtatttgctagtttattacgtgtcagtctaactaattaataacgtacggacctacgtactacgtttcggaccgtacggggaccaaggtacgtaggagactacgaaacgtacgtacggtcggtntacg

SEQ ID NO: 18157 - DNA, 545 bp, Homo sapiens
  misc_feature: GYAE6OF02ILJD6.22.59.F04.1.454.CMB.1.raw
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtncatctacgagggccactggtactcccagcctaggttcagtggcaggtgggtctggggacaggagttcactctcaccatcagcagcctgcagtctgtaagtnttttgctagtttattactgtcagtactacttaataactaactcggtccttaccgtacttagttttcggaccgtaacggggtacccaaggtcgtagggaagacgttaccgaaaccggtaacgtaggtacggcgtacgg

SEQ ID NO: 18158 - DNA, 585 bp, Homo sapiens
  misc_feature: GYAE6OF02JB3YT.22.59.F04.1.454.CMB.1.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggcctcccaggcctcctcatctatggtncatctacgnggccagtggtacncccagcctaggttcagtggctaggtcgggtctggggacaggacgtttcactcgtacaccatcagcacgcctcgcacgtcgtagaagtatttgcttagtttacttacgtgtcagactaacttaagtaacttaacgtcggtacccttaccgttaccgttacggttttacggaccggtaacggggtaacctaacggtccgttagggtaacgtaacgttaaccgtaaaacggtaaccgttacggtacggtaccgtacgg

SEQ ID NO: 18159 - DNA, 523 bp, Homo sapiens
  misc_feature: GYAE6OF02IR9PF.22.59.F04.1.454.CMB.1.raw
  modified_base (210)..(210): a, c, t, g, unknown or other
  misc_feature (210)..(210): n is a, c, g, or t
  modified_base (519)..(519): a, c, t, g, unknown or other
  misc_feature (519)..(519): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagngccacactctcctgcagggccagtcagagtgttagcagcagcttagcctggtaccagcagaaacctggccaggcctcccaggcctcctcatctatggtgcatctacgagggccagtggtactcccagccaggttcagtggcaggtgggtctggggacaggtagtttcactctcaccatcagcagcctgcagtctagaagttatttgacttagtttacttactgtacagctataataataactgccttacgtactagtttcggccgagggaccaaggcgtaggagtacgtacgaaacgtacgtggtcggntacg

SEQ ID NO: 18160 - DNA, 502 bp, Homo sapiens
  misc_feature: GYAE6OF02F1M5I.22.59.F04.1.454.CMB.1.raw
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
  modified_base (498)..(498): a, c, t, g, unknown or other
  misc_feature (498)..(498): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctcccaggctcctcatctatggtncatctacgagggccatggtatcccagccaggttcagtgcagtgggtctgggacaggagttcactctcaccatcagcagcctgcagtctgaagtatttgctagtttattactgtcagcactataataactggcctccgtactagtttcggccgtagggacctaagctaggagactacgaaacgtactgtaggntacg

SEQ ID NO: 18161 - DNA, 620 bp, Homo sapiens
  misc_feature: GYAE6OF02GKVTI.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgtagcagcagcttagcctggtaccagcagaacctggccaggcctcccgaggcctcctcactctatggtgacattcgtacggagggcccacgtggtactccccgagccctagggttcaggtggctagggtcggggtctaggggacaggtacgtttccactctaccacctatcgaagcgacgccgtgctagtcgtaggaagtagttttacgcttaaggttttacttacgttgtacacgtactaacttaattaaacttaaccgttggtacccgttaccgttaacgtttacggttttcggaccggtaacggggtaccctaaacggtccgtacgggtaagtaacgtaaccgtaaaaccggtaacgttggttacgggtaccgtcg

SEQ ID NO: 18162 - DNA, 546 bp, Homo sapiens
  misc_feature: GYAE6OF02IP3TO.22.59.F04.1.454.CMB.1.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctccaggctcctcatctatggtnctatctacggagggccactggtactcccagcctaggttcagtggctaggtgggtctgggacaggtacgttcactcctccacctatcagcacgcctgcagtctagaacgtatttcgcttagtttattacttgtactacgtactaacttataaactaacgtcggtaccctacggttacttaggtttcggaccgtaggggaccaggtacgtaggagtacgtacgtaacgacgtggtacgcgtcg

SEQ ID NO: 18163 - DNA, 558 bp, Homo sapiens
  misc_feature: GYAE6OF02HCILY.22.59.F04.1.454.CMB.1.raw
  modified_base (209)..(209): a, c, t, g, unknown or other
  misc_feature (209)..(209): n is a, c, g, or t
  modified_base (430)..(430): a, c, t, g, unknown or other
  misc_feature (430)..(430): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggctcccaggctcctcatctagtggtgctatcctacggacgggcccacgtggtactccccgaggccctagggttccaaggtcggctaggtggggtctggggacaggtacgtttcactctacacctatcagcagcctgcagtctagaagttntttcgcttactttattactgtacagtactaatataatgtacttggttcctacgtatacctaccgttcggaccgtaagggaccacgtacgtagggaacgtaacgttaaaccggacgttggtacggtacg

SEQ ID NO: 18164 - DNA, 667 bp, Homo sapiens
  misc_feature: GYAE6OF02IO4U2.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtaccagcagaaacctggccaggcctcccaggctcctcatctatggtgcatctagagggccacgtggtactcccgagccgtaggttcaggtggcaggttgggtcgtgggactagacgtttcactcctcgaaccatccgagcacgccgttgaccgtacgttcctagtaaacgttactttttacggacgtttaggtttttaactttacgttaggttaccgttaaggtacctaagtttaatttaaaacgttttaccgttcggttacccgttaccggggttacccggttttaccgggacccgtaaacgggggaaccctaaacgggggttacgggttaaacggttaacccggtaaaaccggtaacggtttacgggttaacgggtcccgttaacggtacccgaacccgttaacg

SEQ ID NO: 18165 - DNA, 599 bp, Homo sapiens
  misc_feature: GYAE6OF02INDPN.22.59.F04.1.454.CMB.1.raw
  modified_base (208)..(208): a, c, t, g, unknown or other
  misc_feature (208)..(208): n is a, c, g, or t
  modified_base (311)..(311): a, c, t, g, unknown or other
  misc_feature (311)..(311): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccaggggaaangccacactctcctgcagggccagtcagagtgtagcagcagtcttagcctaggtaccagcaacgaacctggccaggcctcccgaggcctcctcatctagtggtncactcgtacggagggccacgtggtactcccgagcctaggttcaggtcggctaggttgggtctaggggacaggtacgtttcactctacaccatcagcacgcctgcgtagtcgtagtaagttagttttcgacttagttttattacgttcgtactagtactaacttaattaaacgtaacgtcggtacccttacgttaacgttacggttttacggaccggtaacggggtaacctaacggtacgtacggaacgttacgtaacgtaaaccgtaacgtacggttcggtacgtacg

SEQ ID NO: 18166 - DNA, 517 bp, Homo sapiens
  misc_feature: GYAE6OF02GAI51.22.59.F04.1.454.CMB.1.raw
  modified_base (307)..(307): a, c, t, g, unknown or other
  misc_feature (307)..(307): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtncatctacgagggccatggtactcccagccaggttcaggtggcaggtgggtctggggacaggcgtttcactctcaccatcagcacgcctgcagtctgaagtatttgactagtttacttactgtcagtactactaattaatactggcctcgtactgtttacggccgtacgggaccagtcgtggagtactacgaacgtaacgtgtacggctcg

SEQ ID NO: 18167 - DNA, 592 bp, Homo sapiens
  misc_feature: GYAE6OF02GHOEX.22.59.F04.1.454.CMB.1.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (448)..(448): a, c, t, g, unknown or other
  misc_feature (448)..(448): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagngccacactctcctgcagggccagtcagagtgttagcagcagctagcctggtaccagcagaacctggccaggcctcccaggcctcctcatctagtggtncatctacggaggtccacgtggtactccccgagcccgtaggttccagggtggccgtagggttcggggtcgtagggggacctagggtacgtttacaccttctaccacctagtccagccacggcctgccagtctagtaagttntttcgcttactttattacgtgtacagtactaaatattaaagtcgtaacttcggttactacgtacttccgtaccgttccggaccgtaacgggacctaacgtacggtaggtaacgttaacgttaaccggacttagggtacgtaccg

SEQ ID NO: 18168 - DNA, 509 bp, Homo sapiens
  misc_feature: GYAE6OF02JFKHG.22.59.F04.1.454.CMB.1.raw
  modified_base (208)..(208): a, c, t, g, unknown or other
  misc_feature (208)..(208): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccacactctcctgcagggccagtcagagtgttagcagcagcttagcctggtaccagcagaaccctggccaggctcccaggcctcctcatctatggtgcatcgtacgagggcccagtggtactcccagccaggttcagtggcaggtgggtctgggacagngttcactctcaccntcngcagcctgccagtctagtagtattttgcttagtttattacttgtacagtactatataatacgtgtcctcgtactgttcggcgtagggaccaaggctaggagactacgaacgtacgtgtggctcg

SEQ ID NO: 18169 - DNA, 597 bp, Homo sapiens
  misc_feature: GYAE6OF02HU3AA.22.59.F04.1.454.CMB.1.raw
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
  modified_base (417)..(417): a, c, t, g, unknown or other
  misc_feature (417)..(417): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggaccagcaacgaacctggccaggcctcccgaggtcctcctcatctatggtnctatcgtacggagggccagtggtactcccgagcctaggttcaggtggcaggtgggtctggggaacaggtacgtttcactctaccacctactcagcacgccgggggtncgtacgtcgtagtaagttagttttcgtacttagttttaacttacgttcgtactagtactaacttaataactaacgtcggtacctaccgttacgttacggtttcggaccggtaacgggtaaccgtaaggacgtagggaacgtaacgtaaccgtaaaccgtaacgtacggtacggtcgtacg

SEQ ID NO: 18170 - DNA, 700 bp, Homo sapiens
  misc_feature: GYAE6OF02J1EQ3.22.59.F04.1.454.CMB.1.raw
  modified_base (208)..(208): a, c, t, g, unknown or other
  misc_feature (208)..(208): n is a, c, g, or t
tcagacatacgcgtcacgaccggtgctcgatttagtacacacacttaggattggggaggaactgctcagttaggacccagacggaaccatggaagccccagcgcagcttctcttcctcctgctactctggctcccagtttcagataccactggagaaatagtgatgacgcagtctccagccaccctgtctgtgtctaccaggggaaangcccacactctcctgccagggccagtcagagtgttagcagcagcttagctggtaccagcagaacctggaccaggcctccgaggcctcctcactcgtatggtcgctactacgtaccggaggcccctagtacggtactacccgaggtccctaacgggttcaacgggttcgggactagggttgggttacccgtggggaacaggtacggtttccccagttaccgtccaacccgtagtaccgtacggccgacggtacctcggtaccgtacgttacgtcggtaaagttactttttccggacttaacggtttttactttaacgttccggttactacggtacctaaacgtttaacgttaaacgttaccgtacggttaccttacccggttaactttacggttttaccggtaacccgggtaaggggtacccttaaggtcccggttagtaacgtccggtttaaaccgaaaccggttacgttcgggttaccggtaccgtaacgg

SEQ ID NO: 18171 - DNA, 589 bp, Homo sapiens
  misc_feature: GYAE6OF02HJNXY.22.59.F04.1.454.CMB.1.raw
  modified_base (209)..(209): a, c, t, g, unknown or other
  misc_feature (209)..(209): n is a, c, g, or t
  modified_base (312)..(312): a, c, t, g, unknown or other
  misc_feature (312)..(312): n is a, c, g, or t
  modified_base (428)..(428): a, c, t, g, unknown or other
  misc_feature (428)..(428): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcaagaaacctggccaggcctcccgaggcctcctcatctagtggtcnctatcgtaacggcgggccctagtggtactcccagcctaggttcaggtcggctaggtcggtcgtgggacaggtacgtttcactctacacatcagcagcctgctgtctaggtaagttntttcgacttacttttattacgtcgttacagtacttaaatacttaagtacgtacgtttcggttctacggtacttaccgtacccgttacgggaaccgtaacgggaccgtaaccggtacgtagggtaacgtaaacgttaaaccggtacgttacggacggtaccg

SEQ ID NO: 18172 - DNA, 554 bp, Homo sapiens
  misc_feature: GYAE6OF02FOEKP.22.59.F04.1.454.CMB.1.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (409)..(409): a, c, t, g, unknown or other
  misc_feature (409)..(409): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgtagcagcagcttagcctggtaccagcagaaacctggccaggcctcccaggcctcctcatctatggtncatctacgnggccagtggtactcccagccaggttcagtgcaggtgggtctgggacagtacgttcactctacaccatcagcacgtcctgcagtctagaagtntttgctagtttattacgtgtacgagtactactattaactaactcggtaccttacgttacgttacggtttcggaccgtaacggggtacctaacggtacgttaggaagtacgtaaccgaaaccggtacgtacggtacggtcgtacgg

SEQ ID NO: 18173 - DNA, 538 bp, Homo sapiens
  misc_feature: GYAE6OF02FY22N.22.59.F04.1.454.CMB.1.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagacatacgcgtcacgaccggtgctcgatttagtacacacacttagggagttgggggaggaactgctcagttacggacccagacggaaccatggaagccccagcgcagcttctcttcctcctgctactctggctcccagtttcagataccactggagaaatagtgatgacgcagtctccagccaccctgtctgtgtctccaggggaangccaccctctcctgcagggccagtcagagtgttagcaacacttagtctggtaccagcagagacctggccaggctcccaggcctccgtcatctatggtnctttcaccgagggccagtggtactccccgctaggttcagtcnccagtgggtctgggacagtagttcactcncaccntcagcagcctgcagtctagaagtatttgactactttatactgtcagctaatataatgacttggttctcgtacttcgaccgttccggactaacgggacaacggtacgtaggaacgtaagttaaaccggacgttggtcggactcggaccaccgtac

SEQ ID NO: 18174 - DNA, 557 bp, Homo sapiens
  misc_feature: GYAE6OF02JEBME.22.59.F04.1.454.CMB.1.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcaagaacctggccaggcctcccgaggcctcctcatctatcggtncatctacggagggccagtggtactcccgagtccaggttcaggtcggcaggtgggtctgggacagagtttcactctcaccatcagcacgcctgacagttctagtagtattttgcgttagtttattacgtgtacagtctacttataactaacgtcggtcctaccgttacgtagtttcggaccggtaacggggtacctaacggtcgtacgggaagtacgtacgaaaccgtaacgtcggtacggtctacgg

SEQ ID NO: 18175 - DNA, 563 bp, Homo sapiens
  misc_feature: GYAE6OF02IOVSA.22.59.F04.1.454.CMB.1.raw
  modified_base (211)..(211): a, c, t, g, unknown or other
  misc_feature (211)..(211): n is a, c, g, or t
  modified_base (313)..(313): a, c, t, g, unknown or other
  misc_feature (313)..(313): n is a, c, g, or t
  modified_base (427)..(427): a, c, t, g, unknown or other
  misc_feature (427)..(427): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgttagcagcagcttagcctggtaccaggacacgaaacctggccaggctccaggcctcctcactctatggtcncatcgtacggacggccacgtcggtactccgacgcctaggttcgagtggcaggtcgggtctgggacaggtacgttcactctcacatcacgcacgccgtgctagtcgtagtaagtnttttcgattagtttacttacttcgtacgtagtactaattaactaaacttactcggtaccctcgttacgttacggtttacggacggacgggtaaccaggtcgtaggtagactaacgaacgtacgtcgtacggctacg

SEQ ID NO: 18176 - DNA, 626 bp, Homo sapiens
  misc_feature: GYAE6OF02JTNGI.22.59.F04.1.454.CMB.1.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaaangccacactctcctgcagggccagtcagagtgtagcagcagcttagcctggtaccagcaacgaacctggccaggcctcccgaggcctcctcattcctagtcggtacgctacgtccgtaacggacgggtaccctacgttacgggtacctaccccgaggtcccgtagggtttccaggttcggccgtaggttcgggtcgtaggggactaggtcgttacactctacaccgatcgagcacggtcctagcgtagtcgtagtagttagtttgacgttagtttattacgtgtactagtactacttaataacttaccgtcgtacccttaccgttacgttacgtttaccggaccgtaacggggtaacctagggtaccgtagggaactaacgtaaccgtaaaccgtacggtacgtacggtacctaacgg

SEQ ID NO: 18177 - DNA, 540 bp, Homo sapiens
  misc_feature: GYAE6OF02IU7HF.22.59.F04.1.454.CMB.1.raw
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagctagcctggtaccagcaagaacctggccaggctcccgaggctcctcatctatggtncatcgtagagggccactggtactcccagcctaggttcagtggctaggtcgggtctggggacaggtagttccacgtctccaccgatcagcagccgtgccagtctagagtattttgacttagtttacttacgtgtacagtctaacttataactactcgtacctacgtactaggtttacggaccgtagggtaacctacggcgtaggagtacgtacaacgtacgtgtacggtntacg

SEQ ID NO: 18178 - DNA, 588 bp, Homo sapiens
  misc_feature: GYAE6OF02GP7L8.22.59.F04.1.454.CMB.1.raw
  modified_base (209)..(209): a, c, t, g, unknown or other
  misc_feature (209)..(209): n is a, c, g, or t
  modified_base (342)..(342): a, c, t, g, unknown or other
  misc_feature (342)..(342): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaanagccacactctctgcagggccagtcagagtgttagcagcagcttagcctggtaccagcagaaacctggaccaggctcccgaggcctcctcactctagtggtcgctagtctacggacgggcctacgtcggtacncccgaggcctaggttcaggtggctaggtgggtctgggactaggtacgttcactctcactatcagcacgcctgctagtcgtagtaacgtgttttcgacttaggttttacttacgttgtacgagtcctaataacttaaacgtaacgtcgtacccttaccgtactttacggtttcggacccggtacggggaacctaggtccgtaggtaacgtacgtaacgaaaccggttacggtacggtcggacgtacg

SEQ ID NO: 18179 - DNA, 727 bp, Homo sapiens
  misc_feature: GYAE6OF02IF1IJ.22.59.F04.1.454.CMB.1.raw
  modified_base (185)..(185): a, c, t, g, unknown or other
  misc_feature (185)..(185): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagacatacgcgtcacgaccggtgctcgatttagtacacacacttagggagttgggggaggaactgctcgagttaggacccagaccggaaccatggaagtccccagcgcagcttctcttcctcctgctacgtcgtggctcccagtttcagactaccactggagaaactcgtgatgacgcagtcncgagcccacctgtcctgtgtactccgaggggaaangccacacttctccngcacggccaagtcagtacgttgtagcagcagacttaagcctaggacccagcacgaaacctggccaggtcctcccgaggcctccgtacgacgtctacgtgtacgactacgtcgtacggaccgggtcctaggtggtacctacccgagtaccctaggttccaggttacgacgtaacggtcgggtacctaggggactaggtacgttcgtaacgtcgtacctaaccgtattacgaacgtcgtaaccgtcgtacgtacgtacgtaccgttaacggtaacgtttcgtttccgaactttacggtttaccgtttacggtacggttaccgtaaggtacccgttaaagttaacgttaaaccgtaaaccgttcgggtaccccttaaggttacccgttagggtttaccgggaccggtaacgggtaaccgtacggttaccggtttacggggtaaccttacggtaaacccgtaaaccggttcgttacgggtaccggtacttaacccgg

SEQ ID NO: 18180 - DNA, 701 bp, Homo sapiens
  misc_feature: GYAE6OF02HQIQ0.22.59.F04.1.454.CMB.1.raw
  modified_base (268)..(268): a, c, t, g, unknown or other
  misc_feature (268)..(268): n is a, c, g, or t
  modified_base (461)..(461): a, c, t, g, unknown or other
  misc_feature (461)..(461): n is a, c, g, or t
tcagacatacgcgtcacgaccggtgctcgatttagtacacacacttagggtagtttgggggaggaactgctcagttaggacccagacggaaccatggaagccccagcgcagcttctcttcctcctgctactctggctcccagttcacgataccgactaggagaaatagtgatgacgcacgtctcccacgtccaccctggtctgtcgtcgtaccagggggaacacgccactacgtctccgtcgcgtacggccagtcgaagcgtgttacnctagctaggccttaggccctagggtaaccctaggacctaaggaaccccttggaccgaggtcccttcccgaaggtcctaccgtcgagtcctaagttccgggtacgaccgtactaccggttacggacgggtccacgttccgggaacttcccgaggtccgtaggtcagggtcggtacgaggtgggtctacgggacngttacgtacacctcgtaccaccacgtccacggcctaacggtcctggacgtacgttcgtaggttaacgttattttacgacgttacgtttagttactcgtactaagtacttaacgttaacttaaccgttaacgtccggtaccgttccgtaaccggttaggtttaccgggacggttaacgggaccctaagggtaacctaacgggactaacgtaccggaacgtacggtacggtacgtcctacgg

SEQ ID NO: 18181 - DNA, 621 bp, Homo sapiens
  misc_feature: GYAE6OF02HHGDM.22.59.F04.1.454.CMB.1.raw
  modified_base (209)..(209): a, c, t, g, unknown or other
  misc_feature (209)..(209): n is a, c, g, or t
  modified_base (460)..(460): a, c, t, g, unknown or other
  misc_feature (460)..(460): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaaanagccacactctcctgcagggccagtcagagtgttagcagcagcttagcctggaccagcaagaactcggccaggccctaccgagtcctccgtacactacgtagtcggtcgactactcgtaacggacgggaccctagtcggtaccacccgagccgtaggttcaggtacgcgtagtgtcgtcggtagggactagtacgttcactcgtaccacgactcgacgacacgtcgtcgtactacgttcgtagtaagtttntttgacttagtttaactacgttgtacgatacgtaacttaataaccgttacaccggttccttaccgtaacgtttcggtttaccgggaccggtaacgggtaacctaacggtcggtaagggtaactaacgtaaaccggtaaacgtacgttcgggtacgtaccgg

SEQ ID NO: 18182 - DNA, 548 bp, Homo sapiens
  misc_feature: GYAE6OF02GOUKM.22.59.F04.1.454.CMB.1.raw
  modified_base (209)..(209): a, c, t, g, unknown or other
  misc_feature (209)..(209): n is a, c, g, or t
  modified_base (321)..(321): a, c, t, g, unknown or other
  misc_feature (321)..(321): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcaagaaacctggaccaggcctcccgaggcctcctcactctatgatgctatctacgngggccagtcggcacgtcccagcctaggttcagtcggcaggtcggtctagggactagtctcgactctcacctatcacgcagtcctagacgtcgtagaagtctttgaccttagttacttacgtcgtcagtcacgtcgtagacctaccgtcccgtataccggttcggacgggtaacggtaccgacgggtggaacgtacgtacgaaacggacgtggtacggtctggtaccc

SEQ ID NO: 18183 - DNA, 642 bp, Homo sapiens
  misc_feature: GYAE6OF02FWLEM.22.59.F04.1.454.CMB.1.raw
  modified_base (209)..(209): a, c, t, g, unknown or other
  misc_feature (209)..(209): n is a, c, g, or t
  modified_base (443)..(443): a, c, t, g, unknown or other
  misc_feature (443)..(443): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggcctcccgaggcctcctcatctagtggtgtccttctacccgagggccctaacgtcggtactcccccgactaggttccagtcgcctaggtcgggtctggggacaggtacgttccacttctacacctatcagcgacgtcctgacctaggttcctaggtaaacttnttttacgcttaactttttataccgtttgtacctaagtactaaattaagttaacttcggtaaccgtttcgggtttacctacgttaactttccccgtacccgtttccgggacccgtaaacggggtacctaaccggtaaccgttagggaaacgttaacgtttaaaaccggacggtttacggtacgggtaccttaggaacccc

SEQ ID NO: 18184 - DNA, 636 bp, Homo sapiens
  misc_feature: GYAE6OF02JF1Z5.22.59.F04.1.454.CMB.1.raw
  modified_base (210)..(210): a, c, t, g, unknown or other
  misc_feature (210)..(210): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagacatacgcgtcacgaccggtgctcgatttagtacacacacttagggattgggggaggaacgtgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaacctggccaggctccaggctcctnatctatggtncatcgtacgacggtccacgtggtactcccgagccgtaggttccaaggtggactaggtcgggtctaggggacctaggtacgttccacgtctcgaccatcacgcacgcctgcgtacgtcgtacgtaagttagttttcgacgttagttttaactttacgttaggttactacgtaccttaaccgttaagttaaacttaaccgttacggtacccttaccggttaaccttacggttttacgggacccgtaacgggggtaaccctaacggtaccgttacgggtaacgtaacgttaaccggaaaacggttaccggttacgggttacggtaccgttaccgg

SEQ ID NO: 18185 - DNA, 628 bp, Homo sapiens
  misc_feature: GYAE6OF02IV6MV.22.59.F04.1.454.CMB.1.raw
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccagggaagngccacactctcctgcgagggccagtcagagtgttagcagcagcttagcctggtaccagcagaaccctggaccaggcctcccgaggcctcctcactcgtatggtnctatctacggaggtccacgtggtactcccacgccgtaggttccgaggtggtccgaggtacgggtcgtagggtactaaggtacggtttccgacttccgttcccgaacctacgttccgagtaccgacggtcccttaggcctacggttctaggtagttacgtttgtcttacgtttattacctcgtaccgtaggtacctacgttaagtaacttaacgtccggtaccgtaccgttacgttcgtttacgggaccggtacggggaacctacggtcgtacggtaagtaccgtacgtaaacggtacgtacggtcggtacgtaccg

SEQ ID NO: 18186 - DNA, 764 bp, Homo sapiens
  misc_feature: GYAE6OF02G79V0.22.59.F04.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaanagccacactctcctgcagggccagtcagngtgttagcagcagcttagcctggtaccngcagaacctggccaggctcccaggcctcccgtcattcgtagtggtcgctatcgtacggacgggtcccacgttggtactccccgaaggtcccgtagggttccaaggtcgggacgtaggttggggtacctggggaactagggtacgtttcaaccgttcctaccgtaacccgtataccgtacgtcccgaacggtcccgtacgaccgtacggttaccgttaagggtaaacgtttccgtttttacgggaccttttaagggttttttaactttacggttacggttacctaacggttaccttaaaaccttttaattaaaccgttaaaccggttccggtaaccccgttttaaccgggttaccggttttaccgggtttttaccgggaaccccgggttaaccggggggtaaccccgttaagggtacccggttaaggggtaaccgttaacggttaacccggaaaaccggttaaccggttacggggtttaccgggacccgttaacccggg

SEQ ID NO: 18187 - DNA, 548 bp, Homo sapiens
  misc_feature: GYAE6OF02G0KK4.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccagggggaaanagccacactctcctgcagggccagtcagagtgtagcagcagcttagcctggtaccagcaagaaacctggccaggcctcccgaggtcctcctcatctagtggtgcatcgtacgagggccacgtggtactcccgagcctaggttcaggtcggactaggtgggtctggggactaggtacgtttcactctacacatcagcacgctgcgagtcgtagaagtagtttgacttagtttattacgtgtcagtactactataatacgtcgtacctacgtacgtacgtttcggaccgtacgggaaccaggtcgtaggtagtactacgaaacgtacgtaggtaggctcg

SEQ ID NO: 18188 - DNA, 578 bp, Homo sapiens
  misc_feature: GYAE6OF02IY2DU.22.59.F04.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaaangccacactctcctgcagggccagtcagngtgtagcagcagtctagcctggtaccaggcagaaacctggaccaggcctccgaggcctcctcatctatcggtnctatcgtacggcggcctacgtggtacctccgagccgtaggttccaggtggcgtggtcgggtcgtgggacaggtctttcncgtcnctacatcngcagtcctgcagtcgtagagttntttgactttagtttactacgtgtactagtactaacttattaaacgttacgtcgtaccgttaccgttacgttacggttttcggaccggtaacggggtaacctaacggtcgtaggaacgtacgtaacgaaaccgtacgtagggtacgtctaccgg

SEQ ID NO: 18189 - DNA, 683 bp, Homo sapiens
  misc_feature: GYAE6OF02HQXF7.22.59.F04.1.454.CMB.1.raw
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
tcagacatacgcgtcacgaccggtgctcgatttagtacacacacttagggattgggggaggaactgctcagttaggacccagacggaaccatggaagcccagcgcagcttctcttcctcctgctactctggctccagtttcagataccactggaagaaatagtgatgacgcagtctccagcccaccctgtctggtgtcctccgaagggggaaaagacgccaactactctcctgcgagggccagtcaagtagtgttagcagcagcttagccgtggaccagcagtaaacncggcaggctccagctcctnatcctaagtggtcactatacgtaacggacgggccaccgttagggttaccaccccgtaagggacctaacggggtttcaacgggtcggccgtaacgggttgggggtcccgttagggggaacgtaggtaacgtttcggtaacccttacgtcctaaacccgactaccgaacgcgaaccggtaccgtcgacccgtaagtaccgttaacggtaaacgttacgttttgaacgttacgttttaacgttaacgtttacggttaacacggtactaacttaataaacttaacgtacgtaccgtaccgttatacgttttggaccggtaacgggaccgtaaggtacgtacggtagaacgtacgtaaacgaacggtggtacgtcgtacgg

SEQ ID NO: 18190 - DNA, 552 bp, Homo sapiens
  misc_feature: GYAE6OF02FVMMG.22.59.F04.1.454.CMB.1.raw
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (425)..(425): a, c, t, g, unknown or other
  misc_feature (425)..(425): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcaagaaccctggccagggcctcccgaggcctcctcattctagtggtncatctacggnggccagtggtactcccgagccagggttcaggtcggcaggtgggtctggggacaggtacgtttcactctcaccatcacgcacgcctgcagtctagtaagtntttgcttagtttattacttgtcagtactactaataataactcggtccttcgtactacgtttcggaccggtaacgggacctaagtcgtaggagtacgtaacgaaaccgtacgtcggtacggtactacg

SEQ ID NO: 18191 - DNA, 720 bp, Homo sapiens
  misc_feature: GYAE6OF02J1K41.22.59.F04.1.454.CMB.1.raw
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (420)..(420): a, c, t, g, unknown or other
  misc_feature (420)..(420): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcgagggccagtcagagtgttagcagcagcttacgccgtggtaccagcaagaaccctggccaggcctccgaggcctcctcattcagtggtancctatccgtacggaccgggcctaacgtgggttaccnccccgtagggtcccgtaagggtttccgagggttcggtaacgtcgggttcgggtaccgtggggaaacccnggtaccggttttccaactcgttaccaccctacgttaccgacgtacctacggtcccgtgtaccggtacggttaccgttaaggttacggttacgtttttacgacgtttaacggttttactttaccggttacgttacgtaacgtacctaacgttaacgttaaacgttaaccggttcgtaacccgtttaccgttacggtttacgggtttaccggtaacccgggtacgggtaaccgtaacggtccggttaacggtacgtaacgttaaccgaaacggttaaccggtaggttccggtactacccggg

SEQ ID NO: 18192 - DNA, 669 bp, Homo sapiens
  misc_feature: GYAE6OF02G5E86.22.59.F04.1.454.CMB.1.raw
  modified_base (292)..(292): a, c, t, g, unknown or other
  misc_feature (292)..(292): n is a, c, g, or t
  modified_base (444)..(444): a, c, t, g, unknown or other
  misc_feature (444)..(444): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagagaccaccggagaagttgtgttgacacagtttccagccaccctgtctttgtctccaggagagcggccacctctcctgcagggccaatgagagtagttagcgactacttagcctggtaaccaacagacggcctggccgaggctcccaggctccncatcgtatcgatgtaccttaccgaaaagggcccacgtcgctacgtccccagccgtaggtcgaggtcggcaggtcggtacgtagggaagaggtactctactactaccaccatacaacgacgtacctaagacgtcccgtagaacgtactttacncggtacttaaggtttaacttacgtagttaccgacgacgtaacggtaccttaaaccggaaggttcggttacccgttacccggttacgttttaccggggaccggaaccgggggtaccaacgggtcgtaacgggacgtaccgttacggaacgtaaccggtaacggttcggtacggtccgtacgaccgacccttacggtccgttacgtccttacggttccttaccccgg

SEQ ID NO: 18193 - DNA, 510 bp, Homo sapiens
  misc_feature: GYAE6OF02HP2I7.22.59.F04.1.454.CMB.1.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggcctcctcatctatggtncatctacgagggccagtggtactcccagccaggttcaggtgcaggtgggtctgggacngagttcactctcacatcagcagcctgcagtctagaagtatttgctagtttattactgtacagtcactataataactgcctcgtactagtttcggccgtaagggaccagcgtaggagtactacgaaacgaacgtgtacggctacg

SEQ ID NO: 18194 - DNA, 572 bp, Homo sapiens
  misc_feature: GYAE6OF02HSC8E.22.59.F04.1.454.CMB.1.raw
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctccgaggggaaagacgccacactctcctgcagggccagtcagagtgttagcagcagcttagcctggtaccagcagaacctggccaggctcccaggcctcctcatctatggngcatcacggcggtccagtgtactccgacgccgaggttcaggtggctagggtcgggtcgtaggggacaggtacgttccacgtcctacaccgatcgagcacgcctgctagtcgtaggtaagttattttcgacgttagttttacgttacgtgtactacgtactaacttaataacttaacgtcgtaccttaccgtacgttacgtttacggaccggtaacgggacctaaggcgtaggtagtacgtacgaaacgtacgtagtcgctacg

SEQ ID NO: 18195 - DNA, 704 bp, Homo sapiens
  misc_feature: GYAE6OF02I2R1H.22.59.F04.1.454.CMB.1.raw
  modified_base (210)..(210): a, c, t, g, unknown or other
  misc_feature (210)..(210): n is a, c, g, or t
  modified_base (373)..(373): a, c, t, g, unknown or other
  misc_feature (373)..(373): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcaagaacctggccaaggtcctcccgaggcctacccgtctaactccgtatcgggtcgcctaagttccgtaacgggcgggtaacccctagttaccggggttaacccncccgaacggtcccgttagggtctagggtcggacgtagggtcgggtcgtagggacgtaacggttacgtttacaccgtaccgtaccgtaactacgtaccgacgaccgtaccgtcgtacgaccgtacgtacgttaaggtaacgtttacgtttacgacgtttaagtttacttacgtacgttacgtagtaactaaacgttaagttaaaccgttacgttaccggttaacccgtttaccgttaacgttacggtttaccggtaaccgggtaacgggtaaccgtaggtacgtacggtaacgtaacgttaacgtaaaccgttaggtcggtacgtcgtaacg

SEQ ID NO: 18196 - DNA, 576 bp, Homo sapiens
  misc_feature: GYAE6OF02I556F.22.59.F04.1.454.CMB.1.raw
  modified_base (164)..(164): a, c, t, g, unknown or other
  misc_feature (164)..(164): n is a, c, g, or t
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagngatgacgcagtctccagcccaccctgtctgtgtctccgaggggaaagngccacactctcctgccgaggccagtcagagtgttagcagcagctagcctggtaccagcaagaacctggccaggcctccaggtcctcctnagtcctatcggtncattcgtacggnggcccatggtacctcccgagccgtagttcaggtcggagtcggtggtacgtggaacagtacgttacncgtacncaacctntacgacgcacgctgtacgngttcgtaggtattcgtttgactttgtttactcgtcgtactacgctaaacgttattaaacgttacgtccggttaccttacgttacgttagttccgggaaccggtcgggaaacctgtcgtagactacgtaccgtaaacgtgtacggcgtatacg

SEQ ID NO: 18197 - DNA, 750 bp, Homo sapiens
  misc_feature: GYAE6OF02F286J.22.59.F04.1.454.CMB.1.raw
  modified_base (214)..(214): a, c, t, g, unknown or other
  misc_feature (214)..(214): n is a, c, g, or t
tcagacatacgcgtcacgaccggtgctcgatttagtacacacacttagggagttgggggaggaactgctcagttaggacccagaccggaaccgattggaagcccctagcgtcagcttctcttcctcctgctactctggctcccagtttcagataccactggagaaatagtgatgacgcagttctaccagccacctgtctgtgtctccagggaangccacacgtctcctgcacgggccgagtcagagttcgttacgcagcagtcttaggccttaggtaacccagccaagaacccgtggaccctaggcctccccgagggtcctccctacgactcgtagtcggtagcctagtccgtacggagggtccctagttcggtactcccgagtccgtaaggttaccaaggtcggacgtagggtgggtaccgtaggggacctaagggtacgtttcctaccttaccgtacccgtaacctacgtaccgaacgtaccgtaaccgtaccgtacgtaccgtacggttaccgttacggttaacgtttacgttttacggtacgtttaacgtttttaacgtttaccgttagttaccgttagtaaccttaacgttaacgttaaacgttaaccgttaccggttaaccctttaccgttaccgttacggttttaccggaccggttaaccgggtaacccgtaacggtaccgttaagggtaacggtaacgttaaccggtaaaaccggttacggtacggttacgtaccgttaccg

SEQ ID NO: 18198 - DNA, 560 bp, Homo sapiens
  misc_feature: GYAE6OF02FRX94.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggcctcccaggcctcctcatctatggtgcatctacgacgggccagtggtactcccgagcctaggttccaggtggctaggtgggtctgggacaggacgtttcactctcaccatcagcacgcctcgcagtcgtgaagtatttcgctagtttattacgtgtactagtactactaattaaacttaacgtcggtccttaccgtactacggttttacggaccggtaacggggacctaacggtcgtacggacgtacgtaccgaaacgtacgtaggtcggtctacgg

SEQ ID NO: 18199 - DNA, 631 bp, Homo sapiens
  misc_feature: GYAE6OF02IA2E8.22.59.F04.1.454.CMB.1.raw
  modified_base (247)..(247): a, c, t, g, unknown or other
  misc_feature (247)..(247): n is a, c, g, or t
tcagacatacgcgtcacgaccggtgctcgatttagtacacacacttagggattgggggagaactgctcagttaggacccagacggaaccatggaagccccagcgcagcttctcttcctcctgctactctggctcccagtttcagataccactggagaaatagtgatgacgcagtctcagccaccctgtctgtgtctccgaaggggaaagacgccactatcctcctgcagggcagtcagagtgttagnagcaggacttagccttaggtaccagcaacgaaacctggccaggccctccaacggcctcctcatctatggcacatcgtacggaacggtccagtacggtactcccgagcctaaggtcagtggacacgggttgggtcaggggacaggtactttcgaacttctacgtaccaacttccgaagtcgaagtccgttcggaactagtccgtaaggtaacgttagtttcgtaccttagttttaacgtttacgtacgttacgtacgactaacgttaaacttaaataaccgtcgtacccttacgggttacttaggtttccggacggtacggggtaaccacgtacggtaagtacgtaacgtaaccgtaaaggtaacctacggttacggactaccgg

SEQ ID NO: 18200 - DNA, 687 bp, Homo sapiens
  misc_feature: GYAE6OF02IM3MR.22.59.F04.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
tcagacatacgcgtcacgaccggtgctcgattttagtacacacacttagggagttggggaggaacctgcttcagttaggacccagacggaaccatggaagccccagcgcagcttctctttcctcctgtctactctggctcccagtttcagataccactggagaaattagtgagtagacgcagtctccagccaccctgtctgtgtctcgagggaancgccacnctctccgtgcaggccagtcagtagtgttagcgagcgagtctagccgtaggtaccagcaagaacctggaccaggcctcccgaggtcctccgtnatcctatcggtgcatcgtacggaggccctatggtaactccagccgtaggttcgaggttgcgtaggttgggtaccgtaggggtacctaaggtcgtttactacccttcgtaccgtaacccgtacgttaccgaacgtacaccggtccgtacgtaccgtacgttacgttaacggttaaacgtttagttttcgtacgttttaagttttaacgtttacgttacgttacgtacgaccgttaaaccttaagttaaacttaacggttaccgttacccgttaaccgtttaccggttacggtttttaacggaccggtaacgggtaaccgtaaggtaccgtacggagtaacgtaacgaaaccggtagtacggtacgtacgtaccg

SEQ ID NO: 18201 - DNA, 740 bp, Homo sapiens
  misc_feature: GYAE6OF02JIX5M.22.59.F04.1.454.CMB.1.raw
  modified_base (211)..(211): a, c, t, g, unknown or other
  misc_feature (211)..(211): n is a, c, g, or t
  modified_base (734)..(734): a, c, t, g, unknown or other
  misc_feature (734)..(734): n is a, c, g, or t
tcagacatacgcgtcacgaccggtgctcgatttagtacacacacttagggattgggggaggaactggctcagttaggacccagacggaaccatggaagcccagcgcagcttctcttcctcctgctactctggctcccagtttcagataccactggagaatagtgatgacgcagtctcagccaccctgtctgtcgtcctaccgaggggaaancgccaacgtacctctacctgccgagggtccagtccagacgtgttacgcagcagtcttaagccgttaggtaacccaggacctaacggaaaccccgttggaccctagggacccctacccggaacggcccttcccgtactacgttaccgtaggttcggttacgacccagtttacccgtaaacgggacgggtcccctaaggttccggttaacctacccccgtaggtaccccgttaagggtttccaacggtttcgggaccgtaacgggttttcggggaccgttcgggggaaacctagggggtttaaccctttcctaaccgtacccgtaccgtaaccgtacttaccggacggttacccacggtcccgttacgcgtacgttaccggagttaacgttcgttttcgacgtttaatttactacgtgtacctagtacctaatttaacacgttaaccgtcgtacctcgttacttcggtttgacccggtaagggacctaggtccgtagtactacgtaaccaagtacgtggaccgtntaaccg

SEQ ID NO: 18202 - DNA, 650 bp, Homo sapiens
  misc_feature: GYAE6OF02JAB85.22.59.F04.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
tcagacatacgcgtcacgaccggtgctcgatttagtacacacacttagggattgggggagggaactgctcagttaggacccagacggaaccatggaagccccagcgcagctctcttcctcctgctactctggctcccagtttcagataccactggagaaatagtgatgacgcagtctccagccaccctgtctgtgtctccgagggaagngccacacgtctcctgcgaggccagtcagagtgttagcagcagcttagcctgtaccagcacgaaacgtcggaccgaggtccncccgaggtcctcctcactctagtggtncgactcgaacggcggtaccacgtgtacncccgagcctagttcgagtgcgaggtcgggtacgtcgggacgtaggtacgttctaccgttcgtaccgacccgtacgtacgtacgacgtacgtccgtcggtactcgttacgtacggtaattacgtttacgtcgtttaacgtttacgtttaaccgttagttaccgtacgaccttacgttaacttaacgttaaccgttacgtacccgttacgttaccgttacgttttacggaccgtacggggaaccgtacggttacgtacggtacgtaacgtacgtaaaccggttacgtacgggttacgtccgtaacgg

SEQ ID NO: 18203 - DNA, 700 bp, Homo sapiens
  misc_feature: GYAE6OF02JTSEF.22.59.F04.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
tcagacatacgcgtcacgaccggtgctcgatttagtacacacacttagggattgggggagggaactgctcagttaggacccagacggaaccatggaagccccagcgcagcttctcttcctcctgctactctggcctcccacgtttcagataccactggagaaatagtgatgacgcagtctccacgccaccctgtcctgtcgtctccgagggaacgngaccacactcncctgcaggcacgtcacgagtcgttagcagcagtctacgctacggtacagtcacgaacctcggaccgacgcctaccgngtcctacccgtctactaccgtgtcggtgaccgtactcggtaacgccgggtacgttaccgtacgtacctccgaacgtccgtacggttacgacgggttacggccgtaaggttccgggtcggtacggacggagtacggtttcctacgtctaccaacctcgtacacgccgtacgccgttacgcgttacgccgttaacggagttacgttttcgacgtttacgttttaacgttacgtttcgttaacgaccggttcgtaacgtacccggttaacgtacccttaaccccgtacccgttaccgttaccggggttaccgacggggtaacgggtaaacccggttagggaggtaacgttaaccgtaacgaaacccgttacgtacggcggtaccgtaccgaccgtaccg

SEQ ID NO: 18204 - DNA, 787 bp, Homo sapiens
  misc_feature: GYAE6OF02GPRD2.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggcctcctagtttcagactaccacgtggaagaaatagtgatggacgcagtctccacgccaccctgtctgtcgtcctcgaagggaagacgccacactctctgcgcggccagtcagtagtgtagcgagcgagtcttacgccgtacggtaccgagacgaacgtaaccgtcggaccgacggtcctacccgacggccttccgtacctacttaccgtagtgggtcgtacgtacgttaccggttaccgggaccgggtacccgtacggttacggttaccccgtcccccggtacggttaaccgggtttacgacggtttccggaccggttacggggttcggggttacggtacggggtaaccgtagggttaccgttaccgtaccgttcctaaccgtaacctacggtaccgacgtaccgtaccggtccctacggtacctaacggttcgtaagggttaaactttcggttttaccgactttaacggtttttaacgttcgttacgtacgtaacctaagttaaacttaagttaagttcggtttaaccgttggttaccgtaacgttaccttaccgttacccggttaccgggaaacggtaacgtaacccgaacggttcggtaaaggttaacgtaaacggtttaaacggacggtttcgggtaccgtcgtaacccgg

SEQ ID NO: 18205 - DNA, 595 bp, Homo sapiens
  misc_feature: GYAE6OF02FPMX7.22.59.F04.1.454.CMB.1.raw
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactcctcctgcagggccagtcagagtgttagcagcagcttagcctggtaccagcagaacctggccaggctcccaggcctcctcatctagtggtncatcgtacgagggccactggtactcccgagccaggttccaggtcggctaggtcgggtctggggacaggtacgttcacgtcctacaccatcagcacgcctgccagtctagaagttacttttgcttagttttacttacgttgtactagtacctacttaacttaaacgttaacgtcggtacccgttaccgttacttacggttttcggaccggtaacggggtaacccgtaacggtaccgtagggtaacgtacgtaacgtaaaaccggtacgtacggtacggtagtaccgg

SEQ ID NO: 18206 - DNA, 648 bp, Homo sapiens
  misc_feature: GYAE6OF02IWS63.22.59.F04.1.454.CMB.1.raw
  modified_base (209)..(209): a, c, t, g, unknown or other
  misc_feature (209)..(209): n is a, c, g, or t
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctctgcgacggccagtcagagtgttagcagcagtcttagccgtggtaccagacacgaacctcggccacggcctccgaggtcctacctcaactctagtcggtcnctatccgtacggacgggtcctacgtggtaccncccgagccgtacgtcgaggtcggacgtacgggttcgggtacgtgggactaaggtcgtttaccgacttccgtaccaaccgtatccgacgtactaccgtcccgtaggaccgtaggttcaggtaaagtttcgtttcgacgttaacgttttagtacgttcggtaactagtacccttaagttaacgttaagtccgtacggtcccttacgtagttaccggtttacggaaccggtaacgggtaacctaggtccggtacggtaagtaccgttaacgaaaccggtagttcggtacggtccgtacg

SEQ ID NO: 18207 - DNA, 570 bp, Homo sapiens
  misc_feature: GYAE6OF02GSAXB.22.59.F04.1.454.CMB.1.raw
  modified_base (209)..(209): a, c, t, g, unknown or other
  misc_feature (209)..(209): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaaacctggaccaggcctcccaggcctcctcatctatggtncatcgtacggacgggccacgtggtactcccgagccgaggttcagtggcaggtgggtctgggacagtcgtcacgtctcacactcagcacgcctagcgacgtcgtagtaagttagtttcgacgttagtttattacgttgtacgtagtactacttaattaacttaacgtcgtaccttaccgttacgttacgtttacggaccggtacgggtaaccgtaacggtcgtacggagtactacgtaaacgaacgtcggtacggtctaccg

SEQ ID NO: 18208 - DNA, 652 bp, Homo sapiens
  misc_feature: GYAE6OF02JDZUT.22.59.F04.1.454.CMB.1.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactcctacctggcagggccagtccagagtgttagcgtagcgtagcttacgcctgggtaccagcgaggaaacctggaccaggcctacccgaggtcctaccgtacacttctacttgaattcggactacttccttaaccggtacggggaccctaacgtcgggcctactccccgaacgtccgtaacggtttccaggttcggcgtacgtggggtctacggggacacggtactccgacctaccgtctacccgagttacacgtcgaccgtaccgtaggacgttaccgagttaaacgtatttcgtaccgttatttaccgttacgtacgtacgtacgacgtacgtacgtacgtaaccgtacctaccgtccgtacggttcgggacggaaccgggacgtagggacggagtacgttaacgaaccggtacgttaggcgacgttcgaccg

SEQ ID NO: 18209 - DNA, 576 bp, Homo sapiens
  misc_feature: GYAE6OF02FMRJB.22.59.F04.1.454.CMB.1.raw
  modified_base (257)..(258): a, c, t, g, unknown or other
  misc_feature (257)..(258): n is a, c, g, or t
  modified_base (321)..(321): a, c, t, g, unknown or other
  misc_feature (321)..(321): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggaagaaatagtgatggacgcagtctccagccaccctgtctgtcgtcctccgagggggaaagcgccacactcctcctgcagggccagtcagtagtgtagcagcnnctagcctggtaccagcaagaacctggccagggcctacccgaggcctcctcattcctagtggtnctatcgtacgcggcctagtcggtactccagccgtaggttcaggtggactggtgggtcgcgggacaggtacttcactctacacctncancagtctgcncgtgttgaacgttntttcgacttagtttatcgttatcgaacgtctaatacgttaacgttactcggtaccttacgggtacttaggttaccggacggtaacggtacctaacggtacgtgggaactacgtacgtaaaccggtcgtacggtacgtcgtaccg

SEQ ID NO: 18210 - DNA, 735 bp, Homo sapiens
  misc_feature: GYAE6OF02GCZ1H.22.59.F04.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (311)..(311): a, c, t, g, unknown or other
  misc_feature (311)..(311): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtntctccgagggaangcacactctcctgcacgggccagtcagagtgtagcagcagcttagcttggtaccagacaacgaaacctggaccaggcctccgaggcctcctcagtctagtcgnacgatcgtaacggcggtacccagtacggtaactcccgaggtcctaaggttccaagggttcgaccgttagggtcgggttacgacgggtaacgaggtacgtttacaccgttacgtacctaaccgaactacgacgtaccgaacgtcccgtacggtactaacggttacgttaggtaaacggtttacgttttacggaacgtttaacgttttaacgtttaaccgttacgttacgtaacgtaacgttaacttaaacgtttaaacgttaaacggttacccggtacccggtttaaccgtaaccggtttacgggttttacccggaaccggtaaacgggggtaaacccgtaaaggtaccggttaacggtaacggttaaccgtaacccggtaaaaaccggtaaccggtttaacgggtaccggtaccggtaacccgg

SEQ ID NO: 18211 - DNA, 793 bp, Homo sapiens
  misc_feature: GYAE6OF02F1TSS.22.59.F04.1.454.CMB.1.raw
  modified_base (156)..(156): a, c, t, g, unknown or other
  misc_feature (156)..(156): n is a, c, g, or t
  modified_base (163)..(163): a, c, t, g, unknown or other
  misc_feature (163)..(163): n is a, c, g, or t
  modified_base (169)..(169): a, c, t, g, unknown or other
  misc_feature (169)..(169): n is a, c, g, or t
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (255)..(255): a, c, t, g, unknown or other
  misc_feature (255)..(255): n is a, c, g, or t
tcagacatacgcgtcacgaccggtgctcgatttagtacacacacttagggattgggggaggaactgctcagttaggacccagacggaaccatggaagccccagcgcagctctcttcctcctgctactctggctccagtttcagactaccactgganaaatgtnatgacncagtcctccagccacctgtctgtntctccgaaggggaaanacgccacgtactctcctgcgacgggccacggtcacggattcggtancgacgctaagcgttacgccgtacggtacacggtcaacgaaaccgtcggaccacggccgttacccgacggttcctcccgtactacgtacctacggtggtacctaccgtactttaaccggtaccgggaacggtaccccgacggttaccggttaccgtaccccgaagtcccggtaaggttacctaggggtacccgggtacgttacgggtcggggggtttaccgtaacgggggtaccctaggggttaacgtttccgtaacccggttccgtaaccgtacccgtaaccgttaccggactaaccggccgttaccgtcggtaaccgtacggttaccggtacggtaaaccggtttgtttaaccggtaccgtttacgtttaccggtttaacttcggttaacctacggtacctttaataaaccgtttacgtaaccggttacgttacccgttacgttaacccgtttaggttaccgtacggtaacccggtaacgtaacggtccgttaagggtacaacggttacgaaaccggtatacggtcggtacttacgg

SEQ ID NO: 18212 - DNA, 768 bp, Homo sapiens
  misc_feature: GYAE6OF02JG1IA.22.59.F04.1.454.CMB.1.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaataggtgatgacgcagtctccagcccaccctgtctgtgtctccgaggggaanagccacactctcctgcagggccagtcagngtgtagcagcagcttagcctggaccagcagaacctggaccaggcctcccaggtcctccgtacagtctagtgggtcactactccgtaacggcgggcctacgtaggtactcccgagcccgtagggttccaaggtcggctagggttcgggtacgtaggggacctaggtacgtttccgaccttacgtaccaccgtagtaccgtacgcgtaaccggtccgttaacggccgtaacggttacggtaacggtaaacggttttacgtttttaccgggtaaccgtttttaacggttttaaccgttttaacggttacggtttacccgttaaacggtaaccctttaaaccgtttaaacgtttaaaaccgtttaccgggttacccggggttacccctttaaccgggtttaacgtttacgggttttaccgggaacccgggtaacgggggtaacccttaaacgggtcccggtttaagggaaccgttaaccggtttaaaccggaaaccggttaaccgtacgggttccgggtaacccgttccgg

SEQ ID NO: 18213 - DNA, 595 bp, Homo sapiens
  misc_feature: GYAE6OF02G1EHY.22.59.F04.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (418)..(418): a, c, t, g, unknown or other
  misc_feature (418)..(418): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagngtgttagcagcagcttagcctggtaccagcagaacctggccaggctccaggctccncatctatggtcgctatccgtacgacgggcccacgtgggtactcccgagccgtaggttccaggtcggcgtaggtggggtctggggacaggtcgttccatcctaccaccagtccagccagcccgtnccgtagttcctagtaagttactttgacgttagtttatacgttgttaccagtacctaacttaattaacgtaccgtcggtaccttccggtaatttcgggtttacggacccggtaacggggtaacccaaggtccggtaggaacgtactaccgaaaaccggttactggtacggcttaccgg

SEQ ID NO: 18214 - DNA, 698 bp, Homo sapiens
  misc_feature: GYAE6OF02JOX1D.22.59.F04.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagacatacgcgtcacgaccggtgctcgatttagtacacacacttagggattgggggagggaacgtgctcagttaggacccagacggaaccatggaagcccagcgcagctctcttcctcctgctactctggctcccagtttcagataccactggagaaatagtgatgacgcagtctccagccacctgtctgtgtctccgagggaagngccacactctcctgcacggcagtcacgngtgttacgcagcagtcgttacgccgttggtaaccgacgacaacggaaaccgtcggaccgcgggtaccctcccggaaggtccctcctaccgtaactcgttacgtcggtacgcgtaacttccggttaacggacgggtacccctaacggttggtaccgtacccgacgtaccgtacggttcggacggtttcgggctaaggggttcgggtcgtaaggggaacgtacgttaccgttccgtaactaccgtaccgacctaacgtaacgtaaccgaacgtaccgtaacgacgtaccgtcggtaaccgttacttcgtacgtaccgttaagtttacttaccgtgtacgtacgtcgtacgtaccgttaccgacggtaccgtaccgttccggtacgtttccggaccgggtacggggtaccgtaacggacgtacggacgtacgacgtacggacgtaacgtcggtcgtcgcgtaccg

SEQ ID NO: 18215 - DNA, 693 bp, Homo sapiens
  misc_feature: GYAE6OF02IXB1S.22.59.F04.1.454.CMB.1.raw
  modified_base (208)..(208): a, c, t, g, unknown or other
  misc_feature (208)..(208): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaangccacactctcctgcgaggccagtcagtagtgttagcagcagtcttagcctggtaccagcaagaacctggccaggcctacccgaggtcctccgtacacgttaccgttagtcggtcgcctacgttcgtaacgggacggccctacgttacgggtacctcccgagccgtagggttcaggttcggacgttagggttcggggtacgtacggggaactacggtacgtttcccgtaacgtccgtacctaaccgtagttacccgaaacgggtcccaacggtcccgtcggtaccgttaacgttcggtaaacgggttacgtttagtttaccggtaacgtttaagttttacgtacgttcggtaccgtaacgtactaacgttaactaacgttacgtccgtacccttacggttacgttacgtttcgggaccggtaacggtaaccgtaggtaccgtaggtaacgtaacgtaccgtaaacgtggtacgtccggtataccg

SEQ ID NO: 18216 - DNA, 763 bp, Homo sapiens
  misc_feature: GYAE6OF02HCH97.22.59.F04.1.454.CMB.1.raw
  modified_base (220)..(220): a, c, t, g, unknown or other
  misc_feature (220)..(220): n is a, c, g, or t
tcagacatacgcgtcacgaccggtgctcgattttagtacacacactttagggtagttgggggaggaactgctcaggttaggacccagacggaaccatggaagccccagcgcagcttctcttcctcctgctactctggctcccagtttcagatacccacgtggagaaattcgtgatgacgcagtctccagccaccctgtctgtgtctccgagggggaaacncgaccacactctcctgcagggccagtcagagttgttagcagcagtcttagccgttggtaccagcaacgaaaccctggaccaggcctccccgagggtcctccgtgacttcgtaggttcggtacgcctacgttaccgaacgggacgggtaccctaagttaggtaccacccgagaccgtagggttccgaaggtcggacgtacgggttcggtaccgtacggggaaccaggtacgtttaccgaccttaccgtacccgtaaccgtaagtaccgaaccgtcgaccggtcctacggcgtaacgttcgtaaaggtaacgtttgttttcgaaccgtttaagtttttaacgttaccgtaggttacctacggttaccttaacgtttaaacgttaaacgtttaaccggtccgggttaacccgttaccgggtttacggtttacggtttaccgggaacccgggtaaacgggtaacccgttaacggtcggttaacgggtaacgtaacgttaacccggtaaaaccggtttacggtcgggttaccggtacccggttaacgg

SEQ ID NO: 18217 - DNA, 650 bp, Homo sapiens
  misc_feature: GYAE6OF02HPEFF.22.59.F04.1.454.CMB.1.raw
  modified_base (211)..(211): a, c, t, g, unknown or other
  misc_feature (211)..(211): n is a, c, g, or t
  modified_base (270)..(270): a, c, t, g, unknown or other
  misc_feature (270)..(270): n is a, c, g, or t
  modified_base (436)..(436): a, c, t, g, unknown or other
  misc_feature (436)..(436): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgccgagggccagtcaggagttgtagcagcagcttagcctggtaccngcagaacctggccaggcctcccaggcctcctcatctagtggtcgctactcgtacggacgggccctacggtcggtacctccccgagtcccgtagggttaccacggttggacgtagggtcgggtcgtacggggacaggtacgtttcactcgtaccactactcgacgcncgcctgacgtacgtactaggtaagttagtttcggtaacttaagttttacgtttacgtacgttactaccgtacgtaacttaacgttaaacgtttaccgtaccggtacccgttacgttaaccgttcgggttttcgggacccggtaacgggaccgtaaggtcgtacgggtacggtaacgtaaccggtaaacgtacggttacgggtaggtacgtaccg

SEQ ID NO: 18218 - DNA, 762 bp, Homo sapiens
  misc_feature: GYAE6OF02GMS7Z.22.59.F04.1.454.CMB.1.raw
  modified_base (179)..(179): a, c, t, g, unknown or other
  misc_feature (179)..(179): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgaatgacgcagtcncagccaccctgtctgtgtcctcgaggggaaancgcaacnctctccgtgcgagggccaagtcagagttgtacgcaggcagtcgttacgcttcggaacaggacaacgtaaccgttggaccacggtctccccgaaggtcctccctanagttacctacgtggtcgactacgtcgtaacgggcgggtaccctaagttcgggtaccnccccgaaggtacccgttacggggttaccagggtccgggtacttaagggggtttccccgggttaagtaaccgggggaaactaacggtttccgttaaacccgtcgttacccgtacgtaacccgtacgtacccggtacgtaccgtaaccgtcccggttacgaccggtagttacggttaacggtaacggtttacttttacgtacgtttaaacgttttcttaaaccgttcgtaaccttacggacttaaaccgtttaactaaccgttacgttacggttacccgtttacgtacgttttaacgggttcggtaacccgggtaacgggtaactacgggttaccggtaggtaacgtacgtaaccgtaaacggacgttcggttacgagtacccg

SEQ ID NO: 18219 - DNA, 695 bp, Homo sapiens
  misc_feature: GYAE6OF02HWNS6.22.59.F04.1.454.CMB.1.raw
  modified_base (211)..(211): a, c, t, g, unknown or other
  misc_feature (211)..(211): n is a, c, g, or t
  modified_base (401)..(401): a, c, t, g, unknown or other
  misc_feature (401)..(401): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtcctccgaggggaaancgccacactctcctgcgagggccagtccaggtagttgttagcgagcacgtcgttacgccgtacggtaccagaccgtaacgaaacccgtcggacccacgggccctacccggacggtccctcccgtactacttaccttagtcgggtcaccgtacttacgtacgggacgggacctacggtcggtactacccgngtcccgtaggttcgacggtcggacgtagggtgggtcgtagggacgtacggtacgttccaccgttcacctaccgtataccgacgactacgtcctacgacgtagtacgttaaggtaacgttagttttcgtactttagtttacgttacgtcgttacgacgtacttaattaacttaacgtaccgtacgtacccgttacggttaacgttacggtttacccgggaccggtaaaccgggtacctaaggttaccgaaggtaacacggtaaaccgtaacggtacggtaggtacgtacgtaccg

SEQ ID NO: 18220 - DNA, 730 bp, Homo sapiens
  misc_feature: GYAE6OF02IJT8A.22.59.F04.1.454.CMB.1.raw
  modified_base (208)..(208): a, c, t, g, unknown or other
  misc_feature (208)..(208): n is a, c, g, or t
  modified_base (331)..(331): a, c, t, g, unknown or other
  misc_feature (331)..(331): n is a, c, g, or t
tcagacatacgcgtcacgaccggtgctcgatttagtacacacacttagggattgggggaggaactgctcagttaggacccagacggaccatggaagccccagcgcagcttctcttcctcctgctactctggctcccagtttcagataccactggagaaatagtgatgacgcagtctccagccaccctgtctgtgtctccaggggaaangccacactctctgcgcgggccagtcgagagtgttagcgagcagtcttagcctaggtaccagccaacgtaaaccgtggaccctacggccttacccgaggtcctacccttcgactctagtggtcnctagtaccgacggtacgggcccagtcgtactcccgaggcctagggttcaggtacggcgtacgggttacgggtccggtagggaacgtacggtacgttcacccttccgtaccaaccgtacgttccgacgtacgaaccgtccgtaggtaccgtacggttaccggtaggttaaacgttgttttacgggtacttaacgtttttaacgttaacgttccgtacggtaacgtaccgttaaacgttaaacgttaacgttaaaccgtaccggttaccccgttaaccggtttacttacgggtttaccgggtaccgggtaaaccggggtaaccgtaacggtaccgggttaagtaacgggtaccttaaaccggtaaacccggttaacttacggggttaccggtaactacggg

SEQ ID NO: 18221 - DNA, 711 bp, Homo sapiens
  misc_feature: GYAE6OF02HEM7U.22.59.F04.1.454.CMB.1.raw
  modified_base (213)..(213): a, c, t, g, unknown or other
  misc_feature (213)..(213): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatagtgatgacgcagtctccagcccaccctgtctgtgtcctccgaggggaaangcctacactctcctgcagggccagtcagagtgttagcagcagcttaggcctggtaccagcagacgacctggccaggcctcccgaggtcctccctcaatccttattcgttcgactatcccgagccgtaaggggccccaagttacccggacccccaaggcccgtaagggtttcgacggtcgggacctagggtcggggtcgtacgggtaccaggtacgtttccaaccttccgtacccaaccgtacgtttaccgaagccgaaccggcccgttgacccgaaggttcgtaacggaagtttacgttttcgaacgtttaagtttttaacgtacggttacctacgtaccgtagtaagttaactttaacggtttaccgtacggtacccgttacgggttacccggttacggaaccccggtaaacggggtaccgtaaaggggttaccggtaaacgtaacccggtaaacgtaaccggtgggttaaccggtacgtacggtaccgtaacccgg

SEQ ID NO: 18222 - DNA, 655 bp, Homo sapiens
  misc_feature: GYAE6OF02FRZY8.22.59.F04.1.454.CMB.1.raw
  modified_base (209)..(209): a, c, t, g, unknown or other
  misc_feature (209)..(209): n is a, c, g, or t
  modified_base (319)..(319): a, c, t, g, unknown or other
  misc_feature (319)..(319): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaanacgccacactcctcctgcgagggccagtcagagtgtagcagcagtctagcctaggtaccagcaagaaccgtggaccaggcctcccgaggcctccactacgtctagtggtnactacgtcgacggacggcctacgtcggtacctcccgaggtaccgtaggttcgaggtcgggactaggggttcgggtcgtaggggacctaggtaccgtttcacgtccgtacctaccctagtaccgagccgtacgtcccgtagcccgtacgttacgtaacggtatttacgtttacgacgtttaagttttactaacgtgtacgacgtactaattaactaacgtaccgtacggtcccttacggttacgtttacggttacggaccggtaacgggtaactacggtcggttaacggtaactaacgttacggtaaaaccgtcggttacggtacggtaccgtaccg

SEQ ID NO: 18223 - DNA, 778 bp, Homo sapiens
  misc_feature: GYAE6OF02I5DNB.22.59.F04.1.454.CMB.1.raw
  modified_base (167)..(167): a, c, t, g, unknown or other
  misc_feature (167)..(167): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggcctcccagtttcagataccactggaagaaatagnatgaacgcagtctccagccaccctgtctgtgtctccgagggaaangccacatctcctgcagggccagtcaagngtagtgcagcgancttagccctgggtacccagcaacggaacccgtggccaggcctacccggaggtcctacctcgtaatccgtagtcgggtctaccgtaactccgtaaacgggtccgggccctaacgtttaggtaaacccttccccgaggggtaccctaacggggtttccgaacgggtttcggaccggttacgggtacgggtacggttacccgggggtaaactacgggtaccggttttaaccaacccgtttccggtaacccgtacccgttaaacgttaccgaacggttacccgaaggttccccgtaggtacccgtaggttaccggttacgtaaacgggttatttttacggaaccctttaactttacgtttacgtggtaccgttagtaacctaaagtttacgttaagtaccgttacttacgggtaccgttaccggtaccttaccggttaaccgttacgggaacccgtaaggggtaacccaagggtttaaccgtaagggtaaccttaacggttaaaccggtacggttacggtacggtaacg

SEQ ID NO: 18224 - DNA, 836 bp, Homo sapiens
  misc_feature: GYAE6OF02JBWN0.22.59.F04.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggcctcccagtttcagactaaccactggaagtaaataggtgagtgacgcagtcctccagccacctgtcngtgcgtaccgaagggaancgccacgactctacgtgcgaggcctaggtcaggtagttgtaacgcaggctaagtcttacgccgtaggtaaccagaccgaagtaaaccgtcggaccgacggtccctaccgagtcctaccgtactaacgtcgtagtcggtgtacctaacgtcgtaccgggacggtacccgacgttacggttaacccacccggacgtaccggttacggtaccgtaaggggtcgggtaaccgtaggggttacccgggtacgggttaccgggggaacgttaccgggttaacggtttaccccacgtttaacccgtaacccgtaaacccgttaacgtaaccggtaccgtaccgtaacggtccgttacggtaccggtaacggttaccgttaacgggttaaacgttacggttttaccggtaaccgttttaaacggttttacgtttaaccgtcggtaaaccgtacggttaaacctaaccggttaacgttaaacccgttaaccggccggtttaaacccgttacggttaaccggtttaccgttaaccgggaaccggtaccggggtaacctaacgggtacgttaaccgtacgttaaaccgtaacggtaacccgtaggttacggttacggtaccgtaaccgg

SEQ ID NO: 18225 - DNA, 773 bp, Homo sapiens
  misc_feature: GYAE6OF02FOQ38.22.59.F04.1.454.CMB.1.raw
  modified_base (370)..(370): a, c, t, g, unknown or other
  misc_feature (370)..(370): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggaagaaatagtgatgacgcagtctccagccaccctgtctgtgtctccgaaggggaagacgccacacctctccgtgcgacgggccagtcaggtagttgttagcacgctagtcgttacgccgttaggtaaccaggacctaaacggaaacccgtcgggacccacgggtccctaccccgaacgggtccccttccctacaacttcgtaacggtcggttacnccgttaacgtccggtaacggacgggtaccctacggtacggtacctcccgaacgcccgttagggttcgagggttcgggcgtagggttcgggtaccgtggggaaccgtaggttaccggttctaccgtcgtaaccaccgtagtaccgacgccgtaacggtccttggaccttaggtcgttaaggtaacgtttacgttttatacgttttaacgttttacctacggtttacgaccgttacgtacttaaacgttaaacgtttaaccgtaaccggttccgtaaccgtttaccgggttacgtttacggttaccgggaccgggttaacggggaacccttaagggtccgtacgggttaaaccgtacgttaaacccggtaaaccggtacggtccgggtacgttacccgtaacggg

SEQ ID NO: 18226 - DNA, 649 bp, Homo sapiens
  misc_feature: GYAE6OF02FMQ8R.22.59.F04.1.454.CMB.1.raw
  modified_base (208)..(208): a, c, t, g, unknown or other
  misc_feature (208)..(208): n is a, c, g, or t
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatgtgatgacgcagtctccagccaccctgtctgtgtctcgaggggaanagccacactctcctgcagggccagtcagagttgtagcagcagtcttacgccgtggtaccagcaagaaccctggaccacggcctcccgaggtcctcctcgacttctagtcgggtnctagtccgtagggcgggccctagtggtaccncccgagtccgtagttcgagtcggcgtaggtcgggtcgaggactaggtacgttcacgtcctacaccgtagtcgaacgccgacgtccgtggccgtagtacgttaagttacgtttgtcgttagttttacttacgtcgttacgacgtactacgtttaataacgttaaccgttcgtaccgtttaccgttaacggttacggttttaccgaccgggtaacgggtaaccggtaacggttacggtaacggtacgtaaacgtaaccgtaaacggtaaccggttagtacgggtcgtacgtaacccgg

SEQ ID NO: 18227 - DNA, 598 bp, Homo sapiens
  misc_feature: GYAE6OF02FRXWE.22.59.F04.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
tcagacatacgcgtcacgaccggtgctcgatttagtacacacacttagggattgggggaggaactgctcagttaggacccagacggaaccatggaagccccagctcagcttctcttcctcctgctactctggctcccagaaaccaccgggagaagttgtgttgacacagtctccagccaccctgtctttgtctcaggggaaangccaccctctcctgcagggccagtcagagtgttaactactacttagcctggaccaaacagaaacctggaccaggcctcccaggctcctcatctatgatgcattcttacngggccatcggcatcccagccgaggttcacgtggcgagtgggtctggggacaggtacttcactctcacctaatcagcagcctagacgcctagaagnttttagcttagtttactactcgtcaggtcaggtcgtacgacaccttaccctcgtacggttcgggacgggaacgggaccgtaagggcggtaaacgacgtaacaaaccggtacgttcgggaggtaccgtagtacccgaacctaacgttccgtacgttccttaccgtacctttcccgttaccccgtcttacccg

SEQ ID NO: 18228 - DNA, 531 bp, Homo sapiens
  misc_feature: GYAE6OF02F6P1K.22.59.F04.1.454.CMB.1.raw
  modified_base (209)..(209): a, c, t, g, unknown or other
  misc_feature (209)..(209): n is a, c, g, or t
  modified_base (388)..(388): a, c, t, g, unknown or other
  misc_feature (388)..(388): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggctcccgaggctcctcatctatgatgcatctacaggccagtggcactcccagccaggttcagtgcagtgggtctgggacagcttcactctcaccatcagcagcctagngcctgaagtcttttgactagtttattactgttacagcacgtacgtagacaacctcccttcaccggttcggaccgggtacgggaaccgtaagggtcggtacggaattaccgaaacggtaaccttcgggtggacccttagacccg

SEQ ID NO: 18229 - DNA, 779 bp, Homo sapiens
  misc_feature: GYAE6OF02FGK02.22.59.F04.1.454.CMB.1.raw
  modified_base (207)..(207): a, c, t, g, unknown or other
  misc_feature (207)..(207): n is a, c, g, or t
  modified_base (298)..(298): a, c, t, g, unknown or other
  misc_feature (298)..(298): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatgtgatgacgcagtctcagccacctgtctgtgtctccgaggggaaancgccacactccgtcctgcgacgggcccaagtcagtagtgttacgcaggcagtctacgcctaggtaccagacgaacgaacccgtcgggaccncgggtaccctcccgaggtcctaccctcgtacttactacggtgggttcgacctaacgtacgtaacggacgggtacccctaggtaccgtacctacccgtacggtcccgtaaggttccgtaagggtggtacccgttaaggggtccggggttaacgtacgggggtaaccgtaacggttaccgtttaccgtaacccgtttcgtaaacccgtaccggtaactaacggaccgtaccgaccgtacccgttacggacgtacggttaccgtaaggtaaaccgtttaggttttaccgtacgtttaacggttttaaccttaacggttccgaaccgttacgaacctttaaacttaacgtttaaaaccgtccgttaacccggtacccgtttaccgtttaaccggtttagttacccggaaccgggtaaccgggtacgaaacgtccggtaggaacttaacgttaaccgaaaccggttctcgggtacggtactaacgg

SEQ ID NO: 18230 - DNA, 765 bp, Homo sapiens
  misc_feature: GYAE6OF02J0ZGE.22.59.F04.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (369)..(369): a, c, t, g, unknown or other
  misc_feature (369)..(369): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtcgtctccgagggaangccacnctctccgtgaccgaggccagtcgagtagttgttagccgagcagtcgttagccgttacggtaccagcgaacgaaccgtcggaccacggcctcccgaggcctcctacactcgtagtcggtcgctagtccgacggacggtcctacgtaggttaccncccgacgtaccgtacggttcgaacggttcggacgttaggtcggggttaccgtacgggggaacttaggtaccgttccgacgtttacccacctacccgtagtaaccgtaccgtaccgacgtcccggtagaaccgtacggttacgtaaacgtacggttttaacgtttccggtaacgtttaaagtttttaccggttacgtacgggtaccttaacgtacgttaaacttaacggttaaaccgtaccggtccgttaaaccccggttacggtttaaaccggttacgggttttaccgggaaccccgggaaagggtttaacccctaaggggttccgtaacgggtaaacgttaaccgttaaacccgggtaaacggtttacgccgggtttacccgtaagtacccccgg

SEQ ID NO: 18231 - DNA, 696 bp, Homo sapiens
  misc_feature: GYAE6OF02JMDZ0.22.59.F04.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccctagtttcagataccactggagaaatgtgatgacgcagtctccagccacctgtctgtgtctcgagggaangccanctcnctgcaggccagtcagngttgtagcagcagtctacgctggaccagacaacgtaactggaccagcctaccgagggtccctccgtacattccngttcggacactacgtaccgaggaccgggtcctacgtacggtaccacccgngtacttaacggggtactaggggtcgtacgtacggggttcggggtacccgttaggggaacccgtaggttaaccgtttccgaaccttccgtaccggtaacctacgtacgcgaccgtcgtacgtacgacgtacgtagttacggttaacgtttcgttacgtaacgtttagtttaccgttacgttagtaaccgtacgtacgttaacgttaaacgttaacgttaacggtacccgttaaccgttccgttaacggttacggtttaccggacggtaacccggggtaataccggtagacggtaacgtaccgtaacggtaaccgttaacggtacggtttcggaccgttaccg

SEQ ID NO: 18232 - DNA, 618 bp, Homo sapiens
  misc_feature: GYAE6OF02F6MW1.22.59.F04.1.454.CMB.1.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagtcagaaaccctggaccaggcctcccaggcctcctacactcgtagtggtncagtctacggacgggcctacgtggtactcccagtcccaggttccagtcggctaggtgggtcgtcgggacaggtagttcactcctacgacctatcgagccagcctgcctagtcgtaggtaagttattttcgagttacgttttacttaacgttcggtactacgtactaaacttaagtaaacgttaaccgtcggtacccttaccgttaacgtacgttttacgggacccggtaacggggtaacctaacggtccgtaagggtaacgaacttaaccgaaaacggtacgtcggtacgggtacctaccgg

SEQ ID NO: 18233 - DNA, 676 bp, Homo sapiens
  misc_feature: GYAE6OF02IIUTH.22.59.F04.1.454.CMB.1.raw
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
  modified_base (481)..(481): a, c, t, g, unknown or other
  misc_feature (481)..(481): n is a, c, g, or t
tcagacatacgcgtcacgaccggtgctcgatttagtacacacacttagggattgggggaggaactgctcagttaggacccagacggaaccatggaagccccagcgcagcttctcttctcctgctactctggctccagtttcagactaccactggagaaatgtgatgacgcagtcncagccacctgctgtgtccgtacgaggggaancgccagtacctctcctgacagggccacggtcaaggtacgtgtaacgccgagtcacgtcgttacgccgtggtaccgacgtacgaccgtacgcgacggcgtcccgnggaccgtctacctagtctaccgtagtcgtacgctacgtacggacggtcgacgtaaggtaccgttacccggactcggtaacggttcgnggtaacggtcgggtagcgggttccggtacggaggtaaaccggtcgtaaccgtcctcgtccacgtaacctacgggacacggtccncgtccgaccgtgtacgtagtaacgttattcgggttaattacgttaacttcgtagttacgcgaaacttacgtaactaacttaaccgtaccggttccgttaacgttcgttaacggttccgggaaccgtcgggtaaccggtacggcgttaaggaggttccaaacggttaacggtacgaggtacggcggttactaccgg

SEQ ID NO: 18234 - DNA, 761 bp, Homo sapiens
  misc_feature: GYAE6OF02JQ05Z.22.59.F04.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtcgtctccgaggggaangtccacactctcctgcacgggccagtcgagagtntacgcagcagcttagcctggtaccagcacgaacctggaccaggcctacgacggtctacctanacgttctacgtggcactacgttcgacgacgggcctacgtacggtacctacccgtacggaccctagggtttaccgacggttcggacgttacgggtcggggttcgtaacggggaacctaggttacgttaccacgttcccgtacgtaacccgtacttaccggacggtacctaacgggtccctaacgggaccgtacggttacgtacgttaaacgtttaccgttttcgggaaccttttaagggtttaccttaacggttcgttaacccgtaccggttacctaaggtttaaaccgtttaaccgttaccgggttaaaccggttccccgtaacgggttttactttacccggggttacggtacccgggtaaacgggttaaccggtaaccgtaacgggttaccgggtaagttaacccggttaaacccggtaaccgttaacggttccgggttaggacccttaaccgg

SEQ ID NO: 18235 - DNA, 638 bp, Homo sapiens
  misc_feature: GYAE6OF02I8YCB.22.59.F04.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (467)..(467): a, c, t, g, unknown or other
  misc_feature (467)..(467): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtntctccgaggggaancgcccaccctctcctgcagggccagtcagagtgttagcaatacttagctggtaccagcagacgacctggccaaggcctaccgaggtcctcctcagttctagttgggtctccttaccgtaccgacggggtccctacgttggtacctcccccggacgtacggtttaccaggtcgaccgagggttcgggtcgtggggactaggtacgttccacttccgtaccactagtcgacgtcacgcctgactacgtctaggtacgttntttcgactttatttacgttacgttacgtactagtacttaaagtacttaagtacgtagtttcggtcttaccgtactcccgtaaccgttccggaccgaacgggtaccgtaaccggaggtaggtaaacgtaacgttaaaccggtattcggcggtacctacggacctacgttacg

SEQ ID NO: 18236 - DNA, 734 bp, Homo sapiens
  misc_feature: GYAE6OF02HY8NK.22.59.F04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctccagtttcagataccactggagaaatgtgatgacgcagtctccagccaccctgtcctgtntccgtccgaggggaaancgccaactaccgttcnccgtgcagggccagtcaggtagtcggttagccagcgtagcgttagccgttggtaccagcgaacgaacctggccgacggtcctcccgaggtcctaccgtctactcgtagtcggtacgtcgtactaccgtacggacgggtaccctacgttcgggtaccttaccccgagtaccgtacgggttaccgacggtacggcgtacgggttcggggtaaccgtggggtaactacggtacgtttacctaaccgttaccgtacccgaccgttacgaccgtacggcgaaccgtcctcgaccgttagttacgtacggtaacgttagtttacgtacgtttaagttttacgttacgtttcgtaccgagtaccgtaacgttaacgttaacgttaacggtccgttaccgtacccggtttacgttaccggtttacggtacccggtaacgggtaccgtaagggtaccgtacgggtacgtaacgtaacccggtaaacgtaccggtacggttaccggtcgtaacccgg

SEQ ID NO: 18237 - DNA, 683 bp, Homo sapiens
  misc_feature: GYAE6OF02FU7CS.22.59.F04.1.454.CMB.1.raw
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
  modified_base (418)..(418): a, c, t, g, unknown or other
  misc_feature (418)..(418): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctcccagtttcagataccactggagaaatgtgatgacgnagtctcagccacctgtctgtntcctccgagggtaaacgngccacactctactgctagggccagtcagagtgtagcagcagcttagctggtaccagtcgacgaactcggtaccaggctcccaggctcctcatctagnggttgctagtcgtacggcgggtcccacgtcggtactccgacgccgtagttacgaggtcgacgtacggtcgggtacgtggacgtagtacgttccagtaccttcaccgttancgtacgtacgacgtacccgtgtccgtacgtacttaggaaccgttagttttccggtacttaaggtttttacgtaccgttagtaccgtcgtaacctaactttaaacgttaccgtaaaccgttcgtaccccttaaccgggttacgtttacggtttcccgggtaaccgggtaacggggtacccttaaacggggtaccgttaacgggtaaccgttaagtttaaaccccggaaaaccgggtttacgtccgggtaacggtcgtttaacccgg

SEQ ID NO: 18238 - DNA, 793 bp, Homo sapiens
  misc_feature: GYAE6OF02G9GW2.22.59.F04.1.454.CMB.1.raw
  modified_base (231)..(231): a, c, t, g, unknown or other
  misc_feature (231)..(231): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggcctccctagtttcagacttaccacgtggaagaaataggtgatgacgcagttcctaccgagaccctacccgtgtcgtgtcgtcctaccggaaggggaacncgaccacgtacctcgtccctggaccggacgggcctaggtacgagtacgttagtagacgagctagtctacgtccgtacggtaccagtccaacgtaccgtcggaccacggtcccttaccggacggtccctccgttaacgacgttacgttaggtacggtcgctaacggtaccgtaacgggtaccggacctacggttacggtaacccaccgtaccggtaccggttaacggttcagggtaccgtacggtcgggttcggtacgaacggggacgtaaccgggttacgtaccgaccgtaccgtacccacgtacgtacgtaaccgtccgacgtaccggtacgtaccgtagtaccggttaagtaacgttacgtttacgtacgtttatttacgtacgttagtacgtacgttactaaacttaacgtaacgttaaccgttaccgttaccgttaaccggttaccggtttaccggttacgggttacccggtaaacccgggtacggtaaccggtaccggttaagaaccgtaacgtaaaccggtacgtaaaccgggttcggtaccggacgttaacccgg

SEQ ID NO: 18239 - DNA, 731 bp, Homo sapiens
  misc_feature: GYAE6OF02FXHKN.22.59.F04.1.454.CMB.1.raw
  modified_base (209)..(209): a, c, t, g, unknown or other
  misc_feature (209)..(209): n is a, c, g, or t
  modified_base (710)..(710): a, c, t, g, unknown or other
  misc_feature (710)..(710): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggaagtaaatagtgatgacgcagtctccagccaccctgtctgtgtctcgagggaanagccacactctcctagcgagggccagtcgagtgttgttagacagcgagtcgttacgccgtacggtaacccaggtaccaacgtaaacccgtcgggaccctacggtccctacccggaggtcccttaccctctaacttcgttaggtcggtacgacctagttccggtaaccggacggtccctaagttcggtaccctaccccgtaggtacccgtaagggttccgaagggttcgaccgtagggttaccgggttcggtacggggaacgtaacggttaccgtttacccgaacgtttcccgtaccgtaaaccctacggttaccgaacgccgtaacgtcccgttaggacctaggttaccgttagtaaaccgttttgtttaccggatttacgttttaccggtatcggttacgacctagtaactttaacttaacgtacggtctccgttacgtacgttcggttacggaccggacgggttaccacggtcggacgttaagtacctaacggtaacgnggtttccggtacgacgtaccg

SEQ ID NO: 18240 - DNA, 770 bp, Homo sapiens
  misc_feature: GYAE6OF02GVTU7.22.59.F04.1.454.CMB.1.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaagagccacactctcctgcgacgggccagtcaggagttagttagcgagcagtcgttacgccgtaggtaaccagaccaacggaaacccgtcggacccgaacgggtccctacccgaacgggtccttccccgtacgacttactaggtcggtcgactacgttaccggtaacgggacggggtaccctacgtaggttacctaccccgagtaccgtacggttcgagggttacggcgtagggttcgggtccgtaggggacctaggtaccgtttctaccttccgtacctaacctacgtacgtacgctaccggcctcgactacgtccgttaagttaacgtttacgttttacgacgttttagttttacttacgttcggttaccgtaacgtaccttaacttaaacgttaccgttaaaccgttccggttacccgttaaccgtttaacggttttacgggttttaccgggaaccggggtaacggggttaaccgaaccggggttaacgtacggggttaacgtaacggtaacccggttaaaacggttaaccggttacgggttccggtaccggtaaccgg

SEQ ID NO: 18241 - DNA, 758 bp, Homo sapiens
  misc_feature: GYAE6OF02F0P56.22.59.F04.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (532)..(532): a, c, t, g, unknown or other
  misc_feature (532)..(532): n is a, c, g, or t
  modified_base (738)..(738): a, c, t, g, unknown or other
  misc_feature (738)..(738): n is a, c, g, or t
  modified_base (747)..(747): a, c, t, g, unknown or other
  misc_feature (747)..(747): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgnagtctccagccacctgtctgtcgtctaccgaggggaaancgaccacactctccngcagggccagtcagtacgtgtagctagcagtcttagcctacggtaccagtacaacgaaccgtcggacctacgggtccctaccccggagggtccccttaccctacgtaacgttccgttaacggtcggggttacacctaagttacccgtaacggggacccgggtaccctaaccggttacggtaaccttcccggtaccggtaccgttacgggttaccacgggtcgggtacgtagggggtttccgggttaccggagggtaaccgtacgggtacctttaccgaccgttccctaaccaacctacgttaccgngtaccgaacctcgttaccgcgttaacggtcttaacggaagttttacgtttaccgtacttttaaggttttaaccgttcgttacgtacgtaacgtcccttaaaggttaacctaaaccggttacttccggttcctaaccgttagttacggtttaccgaccggaaccgggtactaacggacggtacggtataacctaacgttaaaccggnggtttacgnggtacctaccg

SEQ ID NO: 18242 - DNA, 716 bp, Homo sapiens
  misc_feature: GYAE6OF02IJOZA.22.59.F04.1.454.CMB.1.raw
  modified_base (517)..(517): a, c, t, g, unknown or other
  misc_feature (517)..(517): n is a, c, g, or t
  modified_base (556)..(556): a, c, t, g, unknown or other
  misc_feature (556)..(556): n is a, c, g, or t
  modified_base (599)..(599): a, c, t, g, unknown or other
  misc_feature (599)..(599): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagactaccactggaagaaatagtgatgacgcagtctccagccacctgtctgtgtctccgaaggggaagacgccactactctcctgcgaggccagtcagagtgtagcagctagtcttagccgtacggtaccagaccaagtaaccgtcggaccacgggtccctaccggaggtcccctaccgtactacttacgttaggtcggtacgtctaacgttaccgacgggacgggtacctaacggttcggtacctacccgacggaccgttaccggtacggtacggtcgacggtacgggtttgggtcggtaacgggtacgtaaccggtacgtttacctaccgtttacacccgtaacctacgtccgaacgtcccgtagtcccggngtaccggtacggttacgttacggttaaagtttcgtttanaccgttttagtttaaactcgttgtactcgtaacaactttaaanaccgttaccgttcgacccgtttaacgttagtttaccggttcggaacccgggtggaaccgtacggtagtacgggtaataacgtaaccgggttaagtccgtaggtaccgtgtaacccgg

SEQ ID NO: 18243 - DNA, 780 bp, Homo sapiens
  misc_feature: GYAE6OF02G5EWX.22.59.F04.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtcgtctccgaggggaaancgccacactctcctgcgagggccagtcagacgtgtagcagcagctagcctggtaccngacagaaccgtggccagccncccgaggcctcctcattcgtagtcggtancctagtccgtacgggcgggacctacgtcggtactccccgaggtcccgtaggtacaggtcgggtagtaggttcgggtccggttaggggaaccttagggtaccttccgtaccgttccgtacctaccgtacgttaccgacgaccgtacccccgtacgtacgtaccgtacgttaccgttaaggttaaacggtttagttttacgtacgttttaaacggtttttaacgtttaacgttacggttaccgtaacgttaaccttaaacgtttaaacgttaaaccgtttaaaccgtttaccggttaaccccgtttaacccggtttaacggtttacggggtttttaccgggaacccgggtaacccggggtaacccgttaaccggggtacggtttaacggggtaacggttaaaccggttaaaccggttaaaaccggttaaccgggtttacgggtacccgggttacggtaacccgg

SEQ ID NO: 18244 - DNA, 732 bp, Homo sapiens
  misc_feature: GYAE6OF02IMQWO.22.59.F04.1.454.CMB.1.raw
  modified_base (144)..(144): a, c, t, g, unknown or other
  misc_feature (144)..(144): n is a, c, g, or t
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (287)..(287): a, c, t, g, unknown or other
  misc_feature (287)..(287): n is a, c, g, or t
tcagacatacgcgtcacgaccggtgctcgatttagtacacacacttagggattgggggaggaactgctcagttaggacccagacggaaccatggaagccccagcgcagcttctcttcctcctgcctactctggctcccagttcngataccactggagaaatagtgagtgacgnagtctaccncgcctacccgtgtctgtcgtcgtacgaggggaaangccgacacgtctccngcacggccagtcgagtagtagtacgcagtcgagtaccgtagtccgtggtaccganacgaaaccgtggaaccgacggtcccgtaccccgacggtacgtcccttactacgtaacgttcgcggttacgtcctacgtacgtaccggacgggtaccgtccggtagtaccgttacgcctcggtaaagtccgtacggtgacggtcgttggacgtggagacgtacgttcgtacgtacctactaccgactgaaccgtcgactacgtacgtacggtactacgttaagtagttacgttacgtacgtttaacgtttacgttacgtacgtacgtaccgtacgtaacgttaacgttaaacttacccggttaaccggtaccgttaacccggtttacttacgggtttaccggtaaacccgggcgggtaaaacctaaccggggtacggttacgttaaccggtaagtaaacccggtacggttaaccgtaaacgggtccggttaccgacggttacccgg

SEQ ID NO: 18245 - DNA, 963 bp, Homo sapiens
  misc_feature: GYAE6OF02F5GZ2.22.59.F04.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagacatacgcgtcacgaccggtgctcgatttagtacacacacttagggattgggggaggaactgctcagttaggacccagacggaaccatggaagccccagcgcagcttctcttcctcctagctacctctggcctcccgtagtttcagactaccacgtggagtaaatgtagactgagctagtcctaccgagcccacccgtgtactgttcgtccgtaccgaggggaaancgaccgaccncgttaccnccgnggtaccgacgggaccctacgttacgaaggtacgttcgttaacggacgtacgacgaacgtacgtttaaccgccccggttaagggtaccccgtaacgacggtaaacccggtaaccgggtacgaacccggggtccccgtaccccgtaacccgggtcctaccccgttacctacgttaacccggttagttacgggtacggtacccgttacggtacccgttaacggtaccggggtcgtaaacccggtttagggtaaccgttacccccgtacggtaacccgttacggtttaaccggtaccggttaaccgggtacgggtacggggttttacgggggttaaccccgggttaggggtaaacggggtaacccggtttaagggttcccttaaccccggttaccggttacccctaaaccggtaccgttaacggaaaccgtccgtaacccggtacccggtacgtaacggttacccgttaaaggtacggttaacgtttagtttaaccgttacgtttaaccgttttaagtttacccgtttagtacccgttagaaccctttaacgtaaagtttaaccgtttaaccgttacgttacccgtttaccggttaaccgttaccgggtttacgggtaaccggaacccggtttaaacgggccggtaagttaacccggtagtaaacccggtacgttaaacggaaccggttccgggttaggtaccgtacggtaaccg

SEQ ID NO: 18246 - DNA, 535 bp, Homo sapiens
  misc_feature: GYAE6OF01EFT47.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggttgtgagacccctgaggagctgggccctggtcccaggcagcgctggccctgctgctgctgggtctggccatggtcgcccatcggcctgctgcgccaatggttgcaccgcgaaacgccggggacccagaccctggacgcctcgagttggaagcagccgatccagcctgcggagccgtgtcggggcagggtcaggccccaaggcccaacccgactgtccacgtcctccg

SEQ ID NO: 18247 - DNA, 534 bp, Homo sapiens
  misc_feature: GYAE6OF01EAMHJ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagaccctgaggagctgggccctggtcccaggcagcgctggccctgctgctgctgggtctggccagtcggtcgcccatggcctgctgcgccaatggtgcacgcaaacgcgggaccagaccctggacgcctcaggttcgaagcagccgatccagcctgcggagcctggtgggcagggtcacggccccgaaggcccaaaccccacgtcgtccactccgttccg

SEQ ID NO: 18248 - DNA, 532 bp, Homo sapiens
  misc_feature: GYAE6OF01EIQCL.14.70.G04.1.454.CMB.1.raw
  modified_base (409)..(409): a, c, t, g, unknown or other
  misc_feature (409)..(409): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgccaatgtncacgcaaagcgggacccagaccctggacgcctcagttcggaagcgagccgatcccagccctgccggagccgtggtcggggcagggtcagccccgaaggcccaacccgactcgtcacctctccg

SEQ ID NO: 18249 - DNA, 543 bp, Homo sapiens
  misc_feature: GYAE6OF01DF6NT.14.70.G04.1.454.CMB.1.raw
  modified_base (518)..(543): a, c, t, g, unknown or other
  misc_feature (518)..(543): n is a, c, g, or t
tcagcgtctagtaccacgaccggtgctcgatttagtgtagtgtgaagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaaagagatcgaacaggcccgtgggagcccgatgactaggtcgggccgaacggaccctagtcagttccgtcctcctcgacgccctaccaaccggaaccgggccctagtccggttccccttcccccgcggaccctacccctccctaccaaggacgccaaccttcgggtcggggaccacgacggcccggtcccggtgggtcctcgtccgtcggtaacgaacggtacccttaccgttacccgtaacgttacggaccgtcgtaggacggggccggtcgtcgggaacgaacggcggactagtagnnnnnnnnnnnnnnnnnnnnnnnnnn

SEQ ID NO: 18250 - DNA, 577 bp, Homo sapiens
  misc_feature: GYAE6OF01BK9US.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctggcctggtcccaggcagcgctggccctgctgctgggtctggccagtggtcgcccatcggcctgctgccgcccaagtggttcgcgaccgcaaacggccgggacccagacccgtggacgccgtcgacggttggaagcagcccgatcccgagcctgcggacgccgtggtcgggcacgggtccacggccccgaaacgggccccaaacccccgacgttcgtaccaccttcctccggttcccccgtacccccg

SEQ ID NO: 18251 - DNA, 614 bp, Homo sapiens
  misc_feature: GYAE6OF01BYSNV.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaaccctgaaggccaatgagacccaagacaggccaagtgggttgtgagacccctggaggagctgggccctggtcccaggcagcgctgcccctgctgctgctgggtctggcctagtcggtcgcccatcggcctgctcgcgcccaatggttcgcgaccgcgaaacggccgggacccacgacccgtggacgcctcgaggttcggaacgcgacgccgactcccgacgcccgtggccggacgtcccgtagggtcggggaccgtacgggtccgacgggacccccgtaaaccgggacccccgaaacccccgtaccgttaccggtaccctaacccgttcccgttacccccggg

SEQ ID NO: 18252 - DNA, 562 bp, Homo sapiens
  misc_feature: GYAE6OF01BLZ2X.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagactccccgaggggtgacagccatggaccctgggaagggcctgggctagggacagggaccagagccagtccagggagaggacagagccaatggactggggtgtactgtaacagccctgctggcgagagggaccagggcaccgtcctccagggancccatgctgcaagtcgggccagaggtgccctgaacctgaaggccaatgagacccaagacaggccaagtggttgtgagacccctgaggagctgggccctggtcccaggcagcgctggccctgctgctgctgggtctggccatgggtcgcccatcggcctgctgcgccccaagtggttgcaccgcaaacggccggggaaccccaggacccctgggacgccctcgaggttggaacgcgagccgatccagcctggcggagccgtggtcggggcagggtccaggaccccaagggcccaaaccccgctacgtccaccgtcttaccccg

SEQ ID NO: 18253 - DNA, 547 bp, Homo sapiens
  misc_feature: GYAE6OF01C6IQO.14.70.G04.1.454.CMB.1.raw
  modified_base (412)..(412): a, c, t, g, unknown or other
  misc_feature (412)..(412): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatcggtcgccatcggcctgctgcgcccatggttcncaccgcaacggcgggacccacggaccctggacgcctcgaggttcggaagccagccgatccagcctagcggacgcccgtggtcggggcaggtcacggcccgaacggcccaaccccgactgtccacgtccgttcccg

SEQ ID NO: 18254 - DNA, 593 bp, Homo sapiens
  misc_feature: GYAE6OF01DOYZV.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaaccctgaaggccaatgagacccaagacaggccaagtggttgtgagacccctgaggagctgggccctggtcccaggcagcgctggcccctgctgctgctggtctggccagtcggtcgcccagtcgggcctgcctcggccgcccaagtcgggttcgccgaaccgcgaaacggccggggaacccacggaccctgggaccgccgtcgaggttcggaagccgacgccgactcccgacgcctggccggacgcccgtgggcggggcagggtcacggccccgaaacgggcccccaaaccccgtactcgtacctccgtccgttaccccg

SEQ ID NO: 18255 - DNA, 599 bp, Homo sapiens
  misc_feature: GYAE6OF01BM54Q.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccagtcggcctgcctgccgcccaatcggttgcaccgcaacggccggggacccagaccccgtggacgccctacgaggttcggaagccgagtcccgaagttcccaggccctaggccgggacgccgtcgggtcgggggccgagggtccgacggcccccgaaacgggacccccaaacccccgacgttaccgtcccaaccgttcccgttaccccgg

SEQ ID NO: 18256 - DNA, 562 bp, Homo sapiens
  misc_feature: GYAE6OF01ECKRP.14.70.G04.1.454.CMB.1.raw
  modified_base (262)..(262): a, c, t, g, unknown or other
  misc_feature (262)..(262): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagaggtncccctgaacctgaaggccaatgagacccaagacaggccaagtgggttgtgagacccctgaggagctgggccctggtcccaggcagcgctcggccctgctgctgctgggtctggccagtcggtcgccatcggcctgctcgcgccatggtgcacgcaacgccgggacccagaccctggacgcctcgagttcggaagcgagccgatccgagcctggccggagtccgtaggtcggggctagggtcgacggaccccgaaacggacccctaaccccgacttacgtacctaccgtccgttaccccgg

SEQ ID NO: 18257 - DNA, 590 bp, Homo sapiens
  misc_feature: GYAE6OF01EKKF0.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctcggccctgctgctgctgggtctggccagtcggtcgcccatcggcctgctcgccgcccaagtcggttcgctaccggacgaaacggccggggaacccacggaccccgtgggacgccgtcgacgttggaacgcgacgccgatcccagcccgtggccggagcccgtggtcggggctagggtccacggaccccgaacgggaccccaaaccccgacttaccgtcctacccgtccgttaccccg

SEQ ID NO: 18258 - DNA, 567 bp, Homo sapiens
  misc_feature: GYAE6OF01D73LZ.14.70.G04.1.454.CMB.1.raw
  modified_base (238)..(238): a, c, t, g, unknown or other
  misc_feature (238)..(238): n is a, c, g, or t
  modified_base (556)..(556): a, c, t, g, unknown or other
  misc_feature (556)..(556): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccagaggtcgcccctgaacctgaaggccaatgagacccaagacaggccaagtgggttgtgagacccctgaggagctgggccctggtcccaggcagcgctggcccctgctgctgctgggtctggcctagtcggtcgcccgagtcggcctgcctcgccgcccaagtgtcgcaccgcgaaacggccgggacccgacgacccgtggacgcctcgacggttcggaagcagcccgatcccagcctggccggacgccgtggtcggggctagggtccacgcccgaacggcccaaccccgactacgtcncgtccgtcccg

SEQ ID NO: 18259 - DNA, 705 bp, Homo sapiens
  misc_feature: GYAE6OF01CW4T5.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagaccctgaggagctgggccctggtcccaggcagcgctggcccctgctgctgctgggtctggccagtcggtccgccctagtcggcctgcctcgccgtccccgaagtcggttcgccgtaaccggcgaaacgggccggggaaccccacggaccccgttagggacgcccgtacgacggtttacggaacggccgtaacggcccgaacgttccccgaacggtccccgttagggacccggggtaacgccccgggttgggtaccgggggggtcccgtaacgggggttcccggaaaccgggtaacccccccgaaaaccggggtccccccgaaaaaccccccccggttaacgttacccggtttaaccccgtaaaccccgtttcccgttttaacccccccggg

SEQ ID NO: 18260 - DNA, 550 bp, Homo sapiens
  misc_feature: GYAE6OF01BJWU9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtggttgtgagacccctgaggagctgggccctggtcccaggcagcgctggcccctgctgctgctgggtctggccagtcggtcgcccatcggcctgctgcgcccaatggttgcaccgcaacgcgggacccagaccctggacgcctcagttcggaagcagccgatcccgagcctggccggagcccgtggtcggggcagggtcacggcccaacggcccaaccccgactcgtccaccgtccgttcccgg

SEQ ID NO: 18261 - DNA, 586 bp, Homo sapiens
  misc_feature: GYAE6OF01DNMUQ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggaggtgcccctgaacctgaaggccaatgagacccaagacaggccaagtgggttgtgagacccctgaggagctgggccctggtcccaggcagcgctggcccctgctgctgctgggtctggccatcggtcgcccagtcggcctgcctgccgcccaagtcggttcgccaccggcaaacggccggggaacccacggacccctggacgcctcgaggttcggaagcgacgccgaatcccgagcctggccggagcccgtggtcggggcagggtcgacggccccgaaacggccccgaaaccccgacctacgtccctaccgttccgtttcccgg

SEQ ID NO: 18262 - DNA, 555 bp, Homo sapiens
  misc_feature: GYAE6OF01CV04W.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccagtggcctgctcgcgcccaatggttgcaccgcgaaacggcggggaacccacgaccctggacgcctcgagttggaagcagctgatccagccgtgcggagccgtggtcggggcagggtccgacgccccgaacggtccccaaaccccgacctcgtccaacgttcccg

SEQ ID NO: 18263 - DNA, 580 bp, Homo sapiens
  misc_feature: GYAE6OF01DDL63.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtgggttgtgagaccctgaggagctgggccctggtcccaggcagcgctggccctgcctgctgcgtggtctggccagtcggtcgcccagtcggcctgctgccgccctaagtcggttgccgaaccgacgaaacgccggggaacccacgacccgtggacgcctacgagttcggaagcgacggcccgaacgtcccaagtccctggccggagccgtggcggggctagggtcacggacccgaaacgggccccaaaccccgactacgtccaccgtcgttacccg

SEQ ID NO: 18264 - DNA, 666 bp, Homo sapiens
  misc_feature: GYAE6OF01DHNR7.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggacggtcgcccctgaacctgaaggccaatgagacccaagacaggccaagtgggttgtgagacccctgaggagctgggccctggtcccaggcagcgctggccctgctgctgctgggtctggccagtcggtcgcccatcggcctcgctcgccgcccctaagtcgggttcgcgtaacccggacgaaacggccggggaaccccacggaccccgtcgggacgcccgtcgacggttgggaacgccgacgggcccgaacgtcccgacgtcccgtcggccgggacggcccgttcgggtacggggggcccgtaacggggttacccggaaccgggtaccccccggaaacgggtaccccccgaaacccccgtaaccgttacccggtacccctaccgttccccgtttacccccggg

SEQ ID NO: 18265 - DNA, 567 bp, Homo sapiens
  misc_feature: GYAE6OF01B1NYS.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggacaatgagacccaagacaggccaagtggtgtgagaccctgaggagctgggccctggtcccaggcagcgctggccctgctgctgctgggtctggccatggtcgcccagtcggcctgctgccgcccaatggttcgcgaccgcgaaacggccggggacccacggaccctggacgcctcgaggttcggaagcgacgccgatccgagccgtgccggacgccgtggtcggggctagggtccacggcccgaacggacccaaaccccgacgtaccgtaccacctcgttaccccgg

SEQ ID NO: 18266 - DNA, 538 bp, Homo sapiens
  misc_feature: GYAE6OF01DRLU6.14.70.G04.1.454.CMB.1.raw
  modified_base (492)..(492): a, c, t, g, unknown or other
  misc_feature (492)..(492): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagaccctgaggagctgggccctggtcccaggcagcgctggcccctgctgctgctgggtctggcatggtcgcccatcggcctgctgccgccaatggttcgcaccgcgaaacgccggggaacccagacccgtggacgcctcaggttcggaacgtcagccgatccagcctgcgagccgtggngggcaggtcacgcccaaggcccaacccgactcgtcacgtctcccgg

SEQ ID NO: 18267 - DNA, 640 bp, Homo sapiens
  misc_feature: GYAE6OF01AOC5V.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggaggtcgcccctgaacctgaaggccaatgagacccaagacaggccaagtggtgtgacgaccctgaggagctgggcctcggtccaggcagcgctcggccctgctgctgctgggtctggccagtcggtccgcccgagtcggtcctcgctcggccgcccgtaagtcggttcgccgtaccgacgaacgggcccggggaacccacggacccgtggacgccgtcgacggttcggaacgcgacggccgacgtacccgacggcccgtcggccgggacgtcccggtcgggtcgggggccgtacggggtcccgaccgggacccccgaaaccgggacccccgtaaacccccgtaccgtaccggtaccctacccgttcccgttacccccgg

SEQ ID NO: 18268 - DNA, 546 bp, Homo sapiens
  misc_feature: GYAE6OF01ETZYM.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggccctgctgctgctgggtctggccagtggtcgcccatcggcctgctgcgcccaatggttgcaccgcaaacgcggggacccagaccctggacgcctcgacgttggaacgcgagccgatccgagcctggcggacgccgtggtggggcagggtccaggccccgaaggcccaaccccgactacgccacgtcctcccg

SEQ ID NO: 18269 - DNA, 644 bp, Homo sapiens
  misc_feature: GYAE6OF01CXNOG.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtcgcccctgaacctgaaggccaatgagaccaagacaggccaagtggttgtgacgaccctggaggagcgtcgggccctcgggtccccgaggccacggccgccgtcggcccctgcctgctggcgtgggtctggcctagtcggtccgccagtcggcctgcctcgccgccctaagtcggttcgcgaccgacgaaaccggccggggaacccacggacccgtcggacgtacccgtcgtacggttacggaacgtccgacggtcccgacgtacccgacgtcccgtcggaccgggacgtcccgtgggtcggggtccgacgggtccgaaccggtaccccgaaaccggccccgtaaacccccgtacgtccgtaccctccgttcccgttccccgg

SEQ ID NO: 18270 - DNA, 594 bp, Homo sapiens
  misc_feature: GYAE6OF01DRO46.14.70.G04.1.454.CMB.1.raw
  modified_base (266)..(266): a, c, t, g, unknown or other
  misc_feature (266)..(266): n is a, c, g, or t
  modified_base (461)..(461): a, c, t, g, unknown or other
  misc_feature (461)..(461): n is a, c, g, or t
  modified_base (577)..(577): a, c, t, g, unknown or other
  misc_feature (577)..(577): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaatggactggggtgtactgtaacagccctgctggcgagagggaccagggcaccgtcctccagggagcccatgctgcaagtcgggccagaggtcnccctgaacctgaaggccaatgagacccaagacaggccaagtgggttgtgagaccctggaggagctgggccctggtcccaggcagcgctggcccctgctgctgctgggtctggccatggtcgcccatcggcctgctgccgcccaagtcggttcgccaccgacgaaacggccggggaacccacggaccctgggaacnccgtcgaggttcggaacgcgacgccgatcccgagcctggccggaggcccgtggtcgggggcctagggtccgacggacccccgaaagggacccccaaaccccgtacgtcggtacccnccgttcccgttaccccg

SEQ ID NO: 18271 - DNA, 666 bp, Homo sapiens
  misc_feature: GYAE6OF01BQPUF.14.70.G04.1.454.CMB.1.raw
  modified_base (313)..(313): a, c, t, g, unknown or other
  misc_feature (313)..(313): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagaccaagacaggccaagtgggttgngacgaccctggaggagcgtcggcctcggtcccaggcagcgctcggccctgctgctgctgggtctggcctagtcggtccgcccgtagtcgggtccgtcggtccgttacggcccgaccccgtaaagttcgggttacgccgtaacccggacgaaaccgggcccggggaacccaccggacccgtcgggaccgtccgtaccgtaacggttcggaacggccgacggacccgtactcccgacgcccgtcggtaccggacgtccggtgggtccggggcgtaacgggtccgaaccggaccccggtaaaccggaccccgtaaaccccaccgttaccggtacccaaccgttcccgttaccccgg

SEQ ID NO: 18272 - DNA, 577 bp, Homo sapiens
  misc_feature: GYAE6OF01EQ2V2.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagaggtgcccctgaacctgaaggccaatgagacccaagacaggccaagtgggttgtgagacccctgaggagctggccctggtcccaggcagcgctcggccctgctgctgctgggtctggccatggtcgcccatggcctgcctgcgccctaatcggttgccaccgaccgaaacggccggggacccacgaccccgtggacgccctcgacggttcggaacgccgacgcccgactcccgagcccgtggccgggacgccgtggtcggggcgagggtccgacgcccgaaacggccccaaaccccgactacgtcctactcccgtcccgg

SEQ ID NO: 18273 - DNA, 557 bp, Homo sapiens
  misc_feature: GYAE6OF01D91ZA.14.70.G04.1.454.CMB.1.raw
  modified_base (548)..(548): a, c, t, g, unknown or other
  misc_feature (548)..(548): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctggatctggccagtcggtcgcccgatcggcctgctcgcgcccaatggttcgcaccgcgaaacggccgggacccagacccgtggacgcctcgagttggaacgcgagccgatccagccgtgcggagccgtggtcggggcacgggtccacggccccgaaacggcccaaaccccgactcgtccnccgttcccg

SEQ ID NO: 18274 - DNA, 665 bp, Homo sapiens
  misc_feature: GYAE6OF01EB6IX.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagaccctgaggagctgggccctggtcccaggcagcgctcggccctgctgctgctgggtctggccagtcggtcgcccagtcggcctgctgccgcccaatggttgcaccgcaagccgggacccacgaccctcgggacgcccgtacgacggttacgggaacggtaccgacggacccggtaacgtacccgaacggcccgttcgggacccgggtaacggtccccggttaggggttccgggggggacccgtaacgggggtacccgaaccgggaccccccgaaaccggggaacccccccgtaaacccccggtaacccgttaccggttacccctaacccgtttcccgtttacccccggg

SEQ ID NO: 18275 - DNA, 551 bp, Homo sapiens
  misc_feature: GYAE6OF01EESYC.14.70.G04.1.454.CMB.1.raw
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccatggcctgctcgcgcccaatcggttgcaccgcaacggcgggacccacggacccgtggacgcctcgaggttcggaagcagccgatccagcctgcggagccgnggtcggggcgaggtcgacgacccgaaggacccaacccgactacgtcncgtcgttacccg

SEQ ID NO: 18276 - DNA, 525 bp, Homo sapiens
  misc_feature: GYAE6OF01EXHR8.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagcaggccaagtgggttgtgagacccctgaggagctgggccctggtcccaggcagcgctggccctgctgctgctggtctggccatggtcgccatggcctgctgcgccaatggttgcaccgcaaagcgggacccagaccctggacgcctcgagttggaagcagccgatccagcctgcggagccgtggtggggcagggtcaggcccgaaggcccaacccactcgtcactctccg

SEQ ID NO: 18277 - DNA, 670 bp, Homo sapiens
  misc_feature: GYAE6OF01AX1GE.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctcggccctgctgctgctgggtctggccagtcggtcgcccagtcggcctggcctcgccgcccgtaagtcggttcgccgaaccggaccgaaacgggcccggggaaccccgacggtaccccgtagggaccggcccgttaccgtaacgggtttcgggaaacggtccgaacgggtaccccggacgttaccccgaacggtccctcgggcccgggaacggccccgttgggggtccgggggtccgaacggggttcccgaccgggacccccgaaacgggacccccaaaccccgtacccgtggtacccctaccgtccccgttaccccg

SEQ ID NO: 18278 - DNA, 622 bp, Homo sapiens
  misc_feature: GYAE6OF01EFH1A.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtgcccctgaacctgaaggccaatgagacccaagacaggccaagtgggttgtgagacccctggaggagcgtgggccctggtcccaggcagcgctcggcccctgctgctgctgggtctggccagtcggtcgcccatcggcccgtcgcgtcgccgcccgtaagtcggttcgcgtaccgacgaaacggccggggacccgacgacccgtcggacgaccgtcgacgttacggaacgacacgggggggaccacgtcccgacgcccgtcggccggacgccgtcggtcggggccgagggtccgaccggaccccgaaaccgggaccccgaaaccccgacccgtaccgtcctacccgttccgttaccccgg

SEQ ID NO: 18279 - DNA, 580 bp, Homo sapiens
  misc_feature: GYAE6OF01CZQ96.14.70.G04.1.454.CMB.1.raw
  modified_base (460)..(460): a, c, t, g, unknown or other
  misc_feature (460)..(460): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccaggacaccgtcctccagggagcccatgctgcaagtcggcagaggtgccctgaacctgaagccaatgagaccaagacaggccaagtcgggttgtgagacccctgaggagctgggtcctggtcccaggcagcgctggcccctgctgctgcgtggtctggcctagtcggtcgcccagtcggcctgctacgccgccctaagtggttcgccgtaaccgcgaaacgcggggaccccaggaccccgtggacnccgtcgaggttcggaacgtccgagcccgatccgacgccgtgcggacgccgtaggtcggggcgagggtcgacggccccgaaacggccccaaccccgactgtaccctacgtccgttaccccg

SEQ ID NO: 18280 - DNA, 567 bp, Homo sapiens
  misc_feature: GYAE6OF01A6EMP.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaaccctgaaggccaatgagacccaagacaggccaagtcgggttgtcgagacccctgaggagctgggcctggtcccaggcagcgctggccctgctgctgctgggtctggccatcggtcgcccatcggcctgctgcgccatgtgcaccgcgaacgcggggacccagacccgtggacgcctcgaggttggaagccgagccgtaatcccagcctggccggagcccgtgggtcggggctagggtccacggaccccgaaacggccccaaacccccgacgttccggtcctacgtccgttacccg

SEQ ID NO: 18281 - DNA, 578 bp, Homo sapiens
  misc_feature: GYAE6OF01CX0DF.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagaccctgaggagctgggcctggtcccaggcagcgctggcccctgctgctgctgggtctggccagtcggtcgccatcggcctgctgcgcccaatcggttcgcaccgcgaaacggccggggaaccccaggacccctgggacgcctcgaggttacggaacgccgagcccgatcccgagccctggccggacgccgtgggtcggggcagggtccacggccccgaaacgggccccaaacccccgactacggtccaccgttcccgttaccg

SEQ ID NO: 18282 - DNA, 576 bp, Homo sapiens
  misc_feature: GYAE6OF01BGAGT.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagacccctgaggagctgggccctggtcccaggcagcgctggccctgctgctgctgggtctggccagtcggtcgcccgatcggcctggctcgcgcccgaatcggttcgcaccggcgaacggccggggaacccacggacccctgggacgcccgtcgacgttggaacgccgtagcccgatcccgagccctggcggacgccgtggtcggggctagggtcacggccccaacgggcccaaccccgacgtacgtccaccgtcgttaccccg

SEQ ID NO: 18283 - DNA, 589 bp, Homo sapiens
  misc_feature: GYAE6OF01D6U7Y.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctgaacctgaaggccaatgagaccaagacaggccaagtgggttgtgagacccctggaggagctgggccctggtcccaggcagcgctcggccctgctgctgctgggtctggcagtcggtcgcccatcggcctgctcgccgccctaagtcggttcgccaccggacgaaacgggccggggaacccacggaccccgtgggacgccgtcgacggttcggaacgccgacggcccgacttcccgacgtcccgtcggcggacgccgtgggtcggggcagggtcacggcccgaacggccccaaccccgactacgcctccgtccgtcccgg

SEQ ID NO: 18284 - DNA, 558 bp, Homo sapiens
  misc_feature: GYAE6OF01B4PEU.14.70.G04.1.454.CMB.1.raw
  modified_base (504)..(504): a, c, t, g, unknown or other
  misc_feature (504)..(504): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagaccctgaggagctgggcctggtcccaggcagcgctggccctgctgctgctgggtctggccagtcggtcgcccatcggcctgctcgccgcccaagtggttcgcaccggacaaacggccggggacccacggacccgtggacgcctcgagttcggaacgcgacgccgactccgacgcctgcggacgccgtggngggcagggtccacggcccaacggcccaaccccactacgtcctccgtcttacccg

SEQ ID NO: 18285 - DNA, 549 bp, Homo sapiens
  misc_feature: GYAE6OF01DVEMG.14.70.G04.1.454.CMB.1.raw
  modified_base (372)..(372): a, c, t, g, unknown or other
  misc_feature (372)..(372): n is a, c, g, or t
  modified_base (538)..(538): a, c, t, g, unknown or other
  misc_feature (538)..(538): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagagtgcccctgaacctgaaggccaatgagacccaagacaggccaagtgggttgtgagaccctgaggagctgggccctggtcccaggcagcgctggccctgctgctgctggtcnggcagtcggtcgccatcggctgctcgccgccaatggttcgcaccgcaaggccgggacccagacccgtggacgccgtcgagttggaagccgagccgatccagccgtgccggtagcccgtggtcggggcagggtcacggacccaacggccccaacccgactcgtaccncgtcctacccg

SEQ ID NO: 18286 - DNA, 630 bp, Homo sapiens
  misc_feature: GYAE6OF01A2FGD.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctggaggagctgggccctggtcccaggcagcgctggcccctgctgctgctgggtctggccagtcgggtccgcccgagtcgggccctggccttcggccggccccaagttcgggtttcgccgaacccggtaccgaaacgggcccgggggaaaccccacggaaccccgtcgggacgtcccgtaccgtaggttcggaaggccaggcccgaatcccgagcccgtggccgggagcccgtgggtcgggggccagggtccgacggacccgaacgggaccccaaaccccgacgtaccgtccaccgttccgttaccccgg

SEQ ID NO: 18287 - DNA, 606 bp, Homo sapiens
  misc_feature: GYAE6OF01EMG3O.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccgaggggacgcccatgctgcaagtcgggccaggaggtcgcccctgaacctgaaggccaagtgagaacccaagacaggaccaagtgggttgtgacgaccctggacggagccgtcgggccctggtccccgaggcacgcgctcggccctgctgctgcgtgggtctggcctagtcggtcgcccagtcggcctgctcgccgtccgaagttggtcgcgtaaccgcgaaacgggccgggaccacgcccgtggacgcctacgacggtcgagccgaggacctagtcccgagccgtacggcggacgccgtaggcggggccagggtccaacggccccgaaaacggaccccgaaaccctacgtagtacccacgttcccgttacccgg

SEQ ID NO: 18288 - DNA, 640 bp, Homo sapiens
  misc_feature: GYAE6OF01BVI2D.14.70.G04.1.454.CMB.1.raw
  modified_base (238)..(238): a, c, t, g, unknown or other
  misc_feature (238)..(238): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccaggagaggacagagccaatggactggggtgtactgtaacagccctgctggcgagagggaccagggcaccgtcctccgagggacncccatgctgcaaggtcgggccaggacggtcgcccctgaacctgaacggccaatgagacccaagacaggccaaggtgggttgtagacgaccccgtgacggagcgtcgggccctcggtcccgaggcgacgccgcgtcggccccgtgcgtcgctcgtcgtcgggtcgtcggccgtagtcggtccgcccgtagtcggcctgccgtcgccgtacccgtaagttcggtcgccgaaccgacgaaacgggcccgggaacccacggtacccgtaggaccgccgtacgtaggttcggaaacgccgaacgtccgaactccgacgtcccgtcggcggacgtccgtgggacgggcgacggtcgacggccccgaaacggccccaaacccgactaccgcctaccgtccgttacccgg

SEQ ID NO: 18289 - DNA, 586 bp, Homo sapiens
  misc_feature: GYAE6OF01DDMIR.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgcaagtcgggccagaggtgcccctgaacctgaaggccaatgagacccaagacaggccaagtgggttgtgagacccctgaggagctgggccctggtccccaggcagcgctggccctgctgctgctgggtctggccatcggtcgcccatcggcctgctgccgcccaagtggttcgcaccgcaaacggcgggacccagaccctgggacgcctcgaggttcgaagccgacgcccgtaagtcccaaggccctggtccggacgcccgtggtcgggggctagggtccacgggacccccgaagggaccccaaacccccgactacggtcctaacccgtccttaccccgg

SEQ ID NO: 18290 - DNA, 740 bp, Homo sapiens
  misc_feature: GYAE6OF01D8CS4.14.70.G04.1.454.CMB.1.raw
  modified_base (328)..(328): a, c, t, g, unknown or other
  misc_feature (328)..(328): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgacgaccaagacaggccaagtggttgtgacgacccgtgaggngcgtgggcctcggtcccaggcagcgctcggccctgctgctgctggtctggccagtcgggtccgcccgtagtcgggcctggccgtcggtaccgaccccgtaagttcgggttacgacccgaacccgggtaccgaaaacggggtccccgggggaaccccgaacggtaacccccgtaggggacctaccccggggggttacctaagggtttaccgggaaacggaccggtaacggaccccggtaacgtcccgaaccggtcccgtacgggaccgggtacggtcccggttcggggtcgggggacccgtaaggggttccccgaaacggggtaaccccccggaaaccggggtaaccccccctaaacccccggaacccgtttacccggtaccccttaacccgttccccgtttaaccccccggg

SEQ ID NO: 18291 - DNA, 661 bp, Homo sapiens
  misc_feature: GYAE6OF01D1H7A.14.70.G04.1.454.CMB.1.raw
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacncccatgctgcaagtcgggccaggaggtgcccctgaacctgaacggccaagtcgaacgacccaaagacaggaccaaaggtggggttgtagacgaccccgtaggacggacgcgtcgggcccgtggtcccgaggcagccgctcggccctgctgctgcgtggtctggctagtcgtcgcctagtcggcctcgctcgccgcccgtaagtcggttcgacaccgacgaaccgggccgggaacccacggtaccccgtacgggacgtacccgtggacggttacggaacgtcgacggtccgaacgtccgaacggtcccgtcggaccgggtacgtcccggtagggtcgggggtaccacgggtcccgaaccggaccccggaaaccggtcccccgaaacccgtaccgtaccgtaccaccgttccccgttaaccccg

SEQ ID NO: 18292 - DNA, 561 bp, Homo sapiens
  misc_feature: GYAE6OF01CAB9Z.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggcccctgctgctgctgggtctggccatggtcgcccatggcctgctcgcgcccaagtcggttgcaccgcgaaagccggggacccagaccctggacgcctcgagttcggaagcgacgccgatccgagccctgcggacgccgtaggtggggccagggtcacggccccgaaacgggcccaaacccccgactacgtcctacgtccgttacccg

SEQ ID NO: 18293 - DNA, 649 bp, Homo sapiens
  misc_feature: GYAE6OF01CMP0Z.14.70.G04.1.454.CMB.1.raw
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggagcccatgctgcaagtcggccagaggtgcccctgaacctgaaggccaatgagacccaagacaggccaagtggtgtgagaccctgaggagctgggcctggtcccaggcagcgcgtggccctgctgctgctggtctggccagtcggtcgcccgatcggcctgcgtcgcgtaccaagtcggttcgccgtaaccgccgaaacgggccggggtaaccccacggaccccgtagggaacgtccctacgaaggttcggaaagtccgtaacggcccgaacgtccgaacggtcccttacgggaccgggtaacgtcccggtgggtaccggggggactacggggtacccgacgggaccccccaaaacgggaccccgtaaaacccccgacgttaccggtacccgtaaccgtttcccgttacccccgg

SEQ ID NO: 18294 - DNA, 753 bp, Homo sapiens
  misc_feature: GYAE6OF01D3RF8.14.70.G04.1.454.CMB.1.raw
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaatggactggggtgtactgtaacagccctgctggcgagaggaccagggcaccgtcctccagggagccatgctgcagtcggcagacggtgcccctagaacctgaacggccaagtcgagacccaagacaaggccgaaaggtcgggtttagtcggacggacccccgttagggaacgggtacgccggtacggggtcccccgtacgggtaccccgagggccgacggtccggcccgtcggtccccgtcggccgttcggcgttcggtcgtcgggttccgtaggcccgtacgtcgggtaccgcccgtacgtcggcccgtggccgtcggaccgtcccgtaaacgtcggttacgaccgaaccggaccggaaaaccggtccggggaacccctaacggggccccgtacggtacggtaccgtccggtaacggtacggtaacggtaccggaaccgtacccgtacgtaacccgtccgggaccgtcggcccgggtacggtccgggtacggtacggggtccgaacggtacccggacgaaccccggaacccgacccgtaaccccgtacccgtaccgttccctaccgttcccgttacccccg

SEQ ID NO: 18295 - DNA, 765 bp, Homo sapiens
  misc_feature: GYAE6OF01CV52C.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtccgggccaggacggtcgccccctagaaaccgtgaaacggccaaatcggaacgaaccccaaaggaccaacggccaaaggtggggttgtggaacgaccccgtggaggagcgtcgggccctcgggtcccaggcacgcgccgtggcccctgctcgctgcgtcgggtctcggccagtcggtccgcccgtagtcgggtcctcggtccgtcggacccggtaccccgtaagttcgggtttaccgaccgtaacccggaccggaaaaccgggcccgggggaaacccccgaaccgggtacccccggtacgggaacccgtacccgttaccggtaacgggtttaacgggaaacggccgtaaccgggcccgtaacgttaccccgaacggtcccgtacgggaccgggtaacggtcccgggttaggggtaccgggggccgtaacggggttcccgaaccggacccccgaaaccgggacccccaaacccccgtacgtaccgtacctaacccgttcccgttacccccggg

SEQ ID NO: 18296 - DNA, 572 bp, Homo sapiens
  misc_feature: GYAE6OF01D1Y07.14.70.G04.1.454.CMB.1.raw
  modified_base (375)..(375): a, c, t, g, unknown or other
  misc_feature (375)..(375): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaaatcgggccagaggtgcccctgaacctgaaggccaatgagacccaagacaggccaagtgggttgtgagacccctggaggagctgggccctggtcccaggcagcgctggcccctgctgctgctggtcnggcagtcggtcgcccatcgggcctgcgtgccgccaatggttcgctaccgacgaaacggccggggaacccacgacccgtcggacgcctcgaggttaggaacgcgaacgccgatcccgacgccgtcggcgacggccgtggtcgggcgacggtcgacgccccgaaggacccaaccccactacgtcctcctccgttacccg

SEQ ID NO: 18297 - DNA, 553 bp, Homo sapiens
  misc_feature: GYAE6OF01ATTUE.14.70.G04.1.454.CMB.1.raw
  modified_base (266)..(266): a, c, t, g, unknown or other
  misc_feature (266)..(266): n is a, c, g, or t
  modified_base (449)..(449): a, c, t, g, unknown or other
  misc_feature (449)..(449): n is a, c, g, or t
  modified_base (476)..(476): a, c, t, g, unknown or other
  misc_feature (476)..(476): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccgagggagcccatgctgcaagtcgggccagaggtncccctgaacctgaagccaatgagacccaagacaggccaagtggtgtgagacccctgaggagctgggccctggtcccaggcagcgctcggcccctgctgctgctgggtctggccagtcggtccgcccagtcggcctgcctggccgccagtgttcgcaccgcgaacggccgggaccacgacccgnggacgcctcgagtgaacgcgagccganccgagcctggcgacgccgtggtcgggccaggtccgacgcccgaaaggcccctacccgactcgccacgtcgttccccg

SEQ ID NO: 18298 - DNA, 644 bp, Homo sapiens
  misc_feature: GYAE6OF01D87AE.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagagtcgccctgaacctgaaggccaatgagacccaagacaggccaagtgggttgtgacgacccctggaggagctgggccctggtcccaggcagcgctcggcccctgctgctgctgggtctggccagtcggtacgcccgagtcgggccttgccttcggccgccccaagttcggttcgccgtacccgacgtaaacggccggggaaccccacggaccccgtgggacgtcccgtacgacggttacggaacgcgacggtcccgacttcccgacggcccgttaggccgggtaacgtccggtgggttcgggggacctagggtacccgacggaccccgaaacgggtacccccaaacccccgacgtaccgtaccgtaaccgttccgttacccccgg

SEQ ID NO: 18299 - DNA, 569 bp, Homo sapiens
  misc_feature: GYAE6OF01BJ2I4.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtccccaggcagcgctcggcccctgctgctgctgggtctggccagtcggtcgcccagtcggcctgctgccgcccaagtcggtgcaccgcgaaacggccggggaacccacggaccctggacgcctcaggttggaagcgagccgatcccgagcctggcggagccgtggtcggggcagggtcgacggccccgaaacggccccaaaccccgactacgtccaccgtccgttccccg

SEQ ID NO: 18300 - DNA, 618 bp, Homo sapiens
  misc_feature: GYAE6OF01EO9AD.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctggaggagctgggccctggtcccaggcagcgctcggccctgctgctgcgtgggtctggccagtcggtccgcccgagtcgggccctgccttcggccgtcccctaagttcgggttcgaccgtacccggacgaaacggccggggaacccacggaccccgtggacgccctcgaggttcggaacggcggaccgactcccgagccctcggcggacggccgtgggtcggggcgacgggtccgacggccccgaacggccccaaaccccgtacgtacgtaccctacctccgtcccgttaccccccg

SEQ ID NO: 18301 - DNA, 695 bp, Homo sapiens
  misc_feature: GYAE6OF01BRE2F.14.70.G04.1.454.CMB.1.raw
  modified_base (328)..(328): a, c, t, g, unknown or other
  misc_feature (328)..(328): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagaccaagacaggccaagtggtgtgagaccctgaggagcgnggccctggtcccgaggcagcgctcggccctgctgctgcgtggtctggctagtcggtcgcccacgtcggccgtcgccgtcggccgtacccgaagttcggttacggaccgtaacccggacgaaaccgggcccggggaaccccgtaccgggaccccgtacgggaccgtcccgtaccggtacggttacgggaacgtaccgacggtcccgaacgttcccgacgtcccgtacgggaccggtacggcccggttagggtccgggggaccgtaacggggttacccgaacccgggaccccggaaaacccgggacccccgtaaaacccccggtacccgttaccggtaccctaccccggttcccgtttacccccccggg

SEQ ID NO: 18302 - DNA, 611 bp, Homo sapiens
  misc_feature: GYAE6OF01DVMS8.14.70.G04.1.454.CMB.1.raw
tcagcgtctagtaccacgaccggtgctcgatttagtgtagtgtgaagggaaaggggagggcagttggtagatgcccctctaggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtggttgtgagaccctgaggagcgtgggccctcggtccaggcagcgctggcccctgctgctggctgggtctggcctagtcggtcgcccgagtcggcctgcctcgccgtccctaacgtggttcgccgtaccgcgaaacggccggggacccaacggacccgtacggacgccgtacgacggttcggaacgccgacgccgtactcccgaggccgtcggccggtacgcccgtgggtacggggcgtagggtccgacggaccccgaacgggaccccaaacccccgtacgtaccgtacctaccgtccgttccccgg

SEQ ID NO: 18303 - DNA, 619 bp, Homo sapiens
  misc_feature: GYAE6OF01E1BDL.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaaggtcgggccagaggtcgcccctgaacctgaacggccaatgagacccaagacaggaccaaggtgggttgtgacgaccctggaggagcgtcgggccctcggtcccaggcagcgcgtcggccctgctcgctgcgtgggtctcggctagtcgggtccgccctagtcggcctgcctcgccgccctagtcggttcgccgtaccgacgaacgggccggggaacccacggaccccgtcgggaccgccgtcgaggttcggaacggccgaacggtcccgactcccgacgcccgtcggcggacgtccgtggtcgggcgaggtcgaccggcccgaaacggcccctaaaccccacgtaccgtccgtaccgtccgttaccccg

SEQ ID NO: 18304 - DNA, 597 bp, Homo sapiens
  misc_feature: GYAE6OF01DKLEO.14.70.G04.1.454.CMB.1.raw
  modified_base (583)..(583): a, c, t, g, unknown or other
  misc_feature (583)..(583): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtccgggccaggacggtcgccccctgaaccctggaaacggccaaatgaagaacccaagacaggccaaggtgggttgtgagacccctggaggagctgggccctggtccccaggcacgcgctcggccctgctgctgctgggtctggccagtcggtcgcccagtcggctcgctcgcgccagtggttcgcgaccgcgaaacggccggggacccacggacccgtgggacgccctcgaggttcggaacgcgagcccgatcccgacgccgtgccggtacgccgtggtcggggcgtagggtcacggccccgaaacggaccccaaccccgactacgtaccnccgttcgttccccg

SEQ ID NO: 18305 - DNA, 578 bp, Homo sapiens
  misc_feature: GYAE6OF01B5MF3.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgaggagggaccagggcaccgtcctccagggacgcccatgctgcaaggtcgggccaggaggtcgcccctgaaccctgaaggccaatgagacccaagacaggccaagtggtgtgagaccctgaggagcgtcgggccctggtcccgaggcgagcgctcggcccctgctgctgcgtgggtctggcctagtcggtcgtcccagtcggccgttgctgccgacccgtaatggttcgacgaccgacgaaaggcccgggaaccacgtaccgtggacgctcgagttaggaactcgacgccgatccgacgccgtgcggacgccgtggtcgggcaggtcacggcccgaaacgccccaaaccccgactcgcctcgtcgtaccccg

SEQ ID NO: 18306 - DNA, 593 bp, Homo sapiens
  misc_feature: GYAE6OF01D4OAH.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggagcccatgctgcaagtcgggccagaggtgcccctgaacctgaaggccaatgagaccaagacaggccaagtgggttgtgagaccctgaggagctgggccctggtcccaggcagcgctggcccctgctgctgcgtgggtctggccagtcggtcgcccagtcggcctgcgtcgccgcccaagttcggttcgcaccgacgaaacgggccggggacccaacggaccccgtaggacgtccgtacgaggttacggaacgccgacggccgtactccacggccctggcggacgccgtggtcggggcagggtccacggaccccgaacggaccccaaaccccgtacacgtccacgttcgttaccccgg

SEQ ID NO: 18307 - DNA, 634 bp, Homo sapiens
  misc_feature: GYAE6OF01A7175.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtggttgtgacgaccctgaggagcgtgggccctggtcccaggcagcgctcggcccctgctgctgctgggtctggccagtcggtcgcccgagtcggcctggctcggccgccctaagtcggttcgcctaaccggcgaaacgggccggggaacccacggtaccccgtggaccgtccgtaccgaggttacggaacgccgacggcccgtactacccgacgtcccgtaggccgggacgtcccggtgggtcggggccgtaaggggtccgaaccgggaccccgaaaccgggccccctaaaccccgaccgttacggtccctaccgttccgttaccccg

SEQ ID NO: 18308 - DNA, 634 bp, Homo sapiens
  misc_feature: GYAE6OF01BYZJB.14.70.G04.1.454.CMB.1.raw
  modified_base (519)..(519): a, c, t, g, unknown or other
  misc_feature (519)..(519): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagaccaagacaggccaagtggtgtgagacccgtgaggagcgtcgggccctggtcccgaggcagcgcgtcggccctgctgctgcgtgggtctggcctagtcggtccgcccgacgtcggcctgccgtcgccgccaagtcggttacgcgaccgacgaaacggccgggaacccgacgacccgtacggacgccgtacgaggttacggaacgccgacgaccgactccgacgtcccgnggccggacgtccggtacgggtcggggccgtacgggtaccgaccggtaccccgaaaccgggacccccgtaaacccccggacgttacccggtacctacccgttcccgttacccccgg

SEQ ID NO: 18309 - DNA, 568 bp, Homo sapiens
  misc_feature: GYAE6OF01EBG5W.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaaacagccctgctggcgagagggaccagggcaccgtcctccagggagcccatgctgcaagtcgggccagaggtcgcccctgaacctgaaaggccaatgagacccaaagacaggccaagtgggttgtgagaccctggaggagctgggccctggtcccaggcagcgctcggcccctgctgctgcgtgggtctggcctagtcggtcgcccagtcggcctgctcgcgccaatggttcgcaaccgcgaaacggccggggaacccacgaccctcgggacgccgtcgagttacggaagcgacgccgatccagcctggcggagcccgtggtcgggcgaggtcacggacccaacggacccaacccaactcgactaccgtctacccg

SEQ ID NO: 18310 - DNA, 523 bp, Homo sapiens
  misc_feature: GYAE6OF01BJXGO.14.70.G04.1.454.CMB.1.raw
  modified_base (237)..(237): a, c, t, g, unknown or other
  misc_feature (237)..(237): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgccatgtgcacgcaacgcgggacccagaccctggacgcctcagttggaagcgagtccgatccagcctgcgngcctgngggcaggtcacgcccaaggcccaaccccgactgtccactcgtcccg

SEQ ID NO: 18311 - DNA, 666 bp, Homo sapiens
  misc_feature: GYAE6OF01DMIX9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccagaggtgcccctgaaccctgaaaggcccaaatgaacgacccaagacaggccaaagtgggttgtgagacccctggaggagctgggccctggtccccagggcagcgctggcccctgctgctgctgggtctggccagtcggtcgcccctagtcgggccctgccgtcggccgtcccctaaagtcggttcgaccgaacccgaccgaaacgggcccggggtaaccccacggaccccgtgggacgcccgttacgacgggttacggaacggccgaacgggtcccgaacgttcccaaggtccctgggcccggtaagcccggttagggtcgggggtaccacggggttccgaacggtaccccgaaacgggaccccctaaacccccgactccgtaccctaccgtcccgttacccccgg

SEQ ID NO: 18312 - DNA, 596 bp, Homo sapiens
  misc_feature: GYAE6OF01B5POV.14.70.G04.1.454.CMB.1.raw
  modified_base (185)..(185): a, c, t, g, unknown or other
  misc_feature (185)..(185): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (505)..(505): a, c, t, g, unknown or other
  misc_feature (505)..(505): n is a, c, g, or t
  modified_base (577)..(577): a, c, t, g, unknown or other
  misc_feature (577)..(577): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccaggagaggacagagccaatggactggggtntactgtaacagccctgctggcgagagggaccagggcaccgtcnccagganccatgctgcaagtcggcagagtcncctgacctgaagcaangagaccaagacagcaagtggtntgagaccctgagagcgtcggcctggtcccgaggcgacgcgtcgtcggcccgtgcgtcgctggtcgtgggtctcggcccgtagtcggtcgcccagttcggccgtcgtcgtcgccgtacccaagtcggttcgacgaccgaacgaacggaccggggtacccaacgacccggtcggacgtccgtacgagtacggaacgcgacgtaccgaacncgaacgccgtggacggacgtcgtacggtcgggccgaggtcgaccggacccgaacggacccctaaccaccgtnaccctcgtccgttaccccg

SEQ ID NO: 18313 - DNA, 660 bp, Homo sapiens
  misc_feature: GYAE6OF01A3973.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtgcccctgaacctgaaggccaatgagacccaagacaggccaaggtggtgtgacgaccctgaggagcgtcgggccctcgggtcccaggcagcgctcggccctgctgctgctgggtctcggcctagtcgggtcgcccgagtcggcctcgccgtcggccgtcccgaagttcggttcgaccgtaacccggacgaaacgggccggggaccccacggacccgtcggacgccgtaccgtaggttacggaacggccgaacggcccgtactacccgacggtcccgtcgggccggacggtcccggttgggtacgggggacctacggggtccgaaccggacccccggaaacccggggaccccctaaacccccgaccgttaccggtcctaaccgttcccgttacccccgg

SEQ ID NO: 18314 - DNA, 539 bp, Homo sapiens
  misc_feature: GYAE6OF01BFCN7.14.70.G04.1.454.CMB.1.raw
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (484)..(484): a, c, t, g, unknown or other
  misc_feature (484)..(484): n is a, c, g, or t
tcagcgtctagtaccacgaccggtgctcgatttagtgtagtgtgaagggaaagggggagagaggagcccagccctgggattttcaggtgttttcatttggtgatcaggactgaacagagagaactcaccatggagtttgggctgaactggcttcttcttgtggctattgtaaaaggtgtccagtgtgaggtgcaactgttggagtctgggggaggcttggtacagcctggggggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttanctgcaaatgaacngctgcgagccgagacacggccctatactactgtgcaagngatcgaacaggcccgtgggacgcccgttgactacgtggggcccagggaccctagg

SEQ ID NO: 18315 - DNA, 645 bp, Homo sapiens
  misc_feature: GYAE6OF01CTE88.14.70.G04.1.454.CMB.1.raw
  modified_base (313)..(313): a, c, t, g, unknown or other
  misc_feature (313)..(313): n is a, c, g, or t
  modified_base (530)..(530): a, c, t, g, unknown or other
  misc_feature (530)..(530): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagccatgctgcaagtcggccaggacggtgccctgaacctgaacggccaatgagacccaagacaggccaaggtgggttntgacgaccctgaggacgcgtgggccctgggtccccaggcagcgcgtcggccctgctgctgctgggtctggcctagtcggtcgccgtagtcggcctgctcgccgccaacgttcggttcgcgaacccggacgaaccgggccgggaacccgacggaccccgtcgggacgtccgtacgacggttacggaacggccacgggcccgaacgtccgacgtcccgnggccggacggcccggttgggaccggggtcgtaagggtccgacccgggtacccgaacccgggaccccaaacccccggtaccgtaccggttacccgtacccgttccgtttacccccg

SEQ ID NO: 18316 - DNA, 642 bp, Homo sapiens
  misc_feature: GYAE6OF01EMBCK.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggcagaggtcgcccctgaacctgaaggccaatgagacccaagacaggaccaagtgggttgtgagacccctgacggagcgtgggccctggtcccaggcagcgctcggccctgctgctgctgggtctggccagtcggtcgccgagtcggcctgctcgccgcccagtcggttcgcgaccgaccgaaacgggccgggaacccacgaccccgtaggacgtacccgtcgaggttacggaacgccgaacggtacccgagtccccgaggcccgtcggaccggaccggtccggtacggtcgggggacctacgggtaccggaccggtaccccgaaaccggggacccccaaaccccccggtacgttacccggtaccctaccgttcccggtttacccccgg

SEQ ID NO: 18317 - DNA, 561 bp, Homo sapiens
  misc_feature: GYAE6OF01DOHEQ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgccctgaacctgaaggccaatgagaccaagacaggccaagtgggttgtgagaccctgaggagctgggccctggtcccaggcagcgctcggccctgctgctgctggtctggccagtggtcgcccatggcctgctcgcgccatgtgcacgcgaacgcgggacccagacccgtggacgcctcgtagttacggaagccgaggtccgactcccgacggcctggccggtacgccgtgggtcggggcacggggtccacggccccgaaggccccaaccccgactcggtccaccgtccgttcccgg

SEQ ID NO: 18318 - DNA, 630 bp, Homo sapiens
  misc_feature: GYAE6OF01C31Z7.14.70.G04.1.454.CMB.1.raw
tcagcgtctagtaccacgaccggtgctcgatttagtgtagtgtgaagggaaaggggagggcagttggtagatgcccctctgggagagactccccgagggggtgacagccatggaccctggaagggcctgggctagggacagggaccagagccagtccagggagaggacagagccaatggactggggtgtactgtaacagccctgctggcgaggagggaccagggcaccgtcctccgagggacgcccatgctgcaagtcgggccagaggtgcccctgaacctgaaggccaatgagacccaagacaggccaaggtgggttgtagacgaccccgtggacggagcgtcgggccctgggtcccaggcacgcgctcggcccctggctcgctgcgtgggtctcggccagtcggtccgcccgtagtcgggcctgcctcggccgaccgaagtcggttcgacaccggacgaaccgggccgggacccacggacccgtcggaaccgcctacgacggttcggaacgcgacggcccgacgtccgacgccgtcggcggacgtcccgtgggcggggcgacgggtccgacggccccgaaacgggacccctaaaccccgacgttcgtaccaccgttcccgttaccccg

SEQ ID NO: 18319 - DNA, 631 bp, Homo sapiens
  misc_feature: GYAE6OF01CAIFU.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtgcccctgaacctgaaggccaatgagacccaagacaggccaagtgggtgtgagacccctgaggagcgtgggccctggtcccaggcagccgcgtcggcccctgctgctgctgggtctggccgagtcggtcgcccagtcgggcctggcctcggccgcccgaagtcggttcgccaccggacgaaacggccggggacccacggaccccgtgggaacgccgtaccgaggttcggaacgccgaacgtccgtaactcccgaggtcccgtacggccggacgcccggtgggtacggggcgtacggggtacgacgggaccccgaaacgggcccccaaaccccgacgttaccgtcccgtaccgttcccgttacccccgg

SEQ ID NO: 18320 - DNA, 670 bp, Homo sapiens
  misc_feature: GYAE6OF01BQWF3.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgacaaggtcgggccaggacggtcgcccctgaacctgaacggccaatgacgaccaagacacggccaaggtgggttgtgacgaccccgtggacggaggcgtcgggcctcggtcccgaggcacgcgcgtcggccctgctcgctcggcgtcgggtctcggcctacgtcggtccgcccgtagtcggcctgcctcgccgtcctaagttcggttacgcgaaccgacgaacgggccgggaacccacgacccgtggacgtccgtacgtacggttacggaacgcgacgtaccgacgtcccgacggtccgtcggaccgggacgtccgggtcgggtacggggtccgtacgggtaccgacccgggaccccgtaaaccgggacccccgtaaacccccgtacgttaccggtaccctaccgttcccggtttacccccgg

SEQ ID NO: 18321 - DNA, 589 bp, Homo sapiens
  misc_feature: GYAE6OF01BBT09.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgccctgacctgaaggccaatgagacccaagacaggccaagtggttgtgagacccctgaggagctgggccctggtcccaggcagcgctggccctgctgctgctgggtctggccagtcggtcgcccgagtcgggcctgctcgccgcccgtaatcggttcgccgaccgcgaaacgggccggggaaccccacggacccgtgggacgccgtcgaggttcggaagtcgaggcccgatcccgagccctggccggagcccgtggtcggggcgtagggtccgacggccccgaaacgggccccaaaccccgcgtacgtccaccgtccgttaccccgg

SEQ ID NO: 18322 - DNA, 683 bp, Homo sapiens
  misc_feature: GYAE6OF01BJE6I.14.70.G04.1.454.CMB.1.raw
  modified_base (312)..(312): a, c, t, g, unknown or other
  misc_feature (312)..(312): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgaggaggaccagggcaccgtcctccgagggagcccatgcctgcaaggtcgggccagaggtcgccctgaacctgaaggccaatgagaccaagacagccaagtggtgngacgaccctgaggagcgtcggcccgtcggtcccgacggcgacgcgcgtcggcccctgccgtgcgtggccgttcgggtcgtacggccgtagttcgggtccgcccgtagtcgggccgtgccgtcggccgcccgtaagttcggttacgccgtaccggaccgaaacgggcccgggaaccccgtacggacccgtacgggaccgtccgtaccggtaaggttacggaacgtaccgaaggtccccggactaccggacggtcccgtcggccgggacgtccggtacgggtcggggtaccggtagggttccggaccggccccgaaaccgggaccccgaaacccgacccgttaccggtaccctaccgttcccgtttaccccgg

SEQ ID NO: 18323 - DNA, 584 bp, Homo sapiens
  misc_feature: GYAE6OF01AH56X.14.70.G04.1.454.CMB.1.raw
  modified_base (265)..(265): a, c, t, g, unknown or other
  misc_feature (265)..(265): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtncccctgaacctgaaggccaatgagacccaagacaggccaagtggttgtgagacccctgaggagctgggccctggtccccaggcagcgctcggcccctgctgctgcgtgggtctggccagtggtcgcccatcggcctgctcgcgcccagtggttcgcaccgcgaacggccgggacccacggacccgtggacgcctcgacgttggaacgtcgacgcccgatcccaggccctggccggacgccgtggacggggtccgaagggtccgacgccccgaacggcccccgaaaccccgacttacgccctaccgttccgttaccccgg

SEQ ID NO: 18324 - DNA, 589 bp, Homo sapiens
  misc_feature: GYAE6OF01DYKPY.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtggtcgcccatcggcctgctcgccgcccaaagtggttgactaccgacaaacggccggggaccccaggacccctgggacgcccgtcgaggttcggaagccgaagcccgaatcccgaagcccgtgccggagcccgtgggtcggggcagggtccaacggccccgaaagggcccccaaaccccgaccgtcgtaccaccgtccgttaccccgg

SEQ ID NO: 18325 - DNA, 749 bp, Homo sapiens
  misc_feature: GYAE6OF01EO0RF.14.70.G04.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagnggaccagggcaccgtctccgagggacnccatgctgcaagtcgggccaggaggtcgccctgaacctgaacggccaatgacgacccaaagacaaggccaagtgggttgtgacgacccctgaggacgcgtgggcctggtcccaggcagccgctcggccctgctgctcgctggtctggccagtcggtacgcccgtactcggtccctggcctcggccgtacccgaacgttgggtcgaccgtaccgaccgaaacgggcccgggaacccgaccggacccgtagggaccgtacccgtacgtaacggttacggaacgtacccggacgtccccggtaaacgttccccgaacgggtccccttacggggacccgggtaaccgggttccccggttaacggggtttccggggggaacccgttaacggggggtttaccccgtaaaacccggggaccccccggaaaacccgggtaccccccggtaaaaaccccccggtaccgtttacccgggtaaccccgtaaacccgttttcccccggttttaaccccccgggg

SEQ ID NO: 18326 - DNA, 608 bp, Homo sapiens
  misc_feature: GYAE6OF01A65S0.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccagaggtgcccctagaaccctgaacggccaagtgaagacccaagacaggccaaagtggttgtgagacccctgaggagctgggccctggtcccaggcagcgctcggccctgctgctgcgtgggtctcggctagtcgggtcgcccgagtcggcctcgcgtcgccgcctaagtcggttcgccgaccggacgaacgccggggacccacgtacccgtggacgcctacgacggttgaagccgagcccgactcgacgcctcggccggacgccgtgggtcgggcgaggtccgaacggccccgaacgggtaccccccaaaccccgtacgtacgtccctaaccgttccgttacccccgg

SEQ ID NO: 18327 - DNA, 603 bp, Homo sapiens
  misc_feature: GYAE6OF01B39TC.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccaggaggtgcccctgaacctgaaggccaatgaagaccaagacaggccaaggtgggttgtgacgaccctgaggagcgtcgggcctggtcccaggcagcgcgtcggccctgcgtgcgtgcgtcgggtctcggccagtcggtacgccgagtcggctgcgtcgccgtccaagtcggtacgccgacgacgaacggccgggacccacgacccgtggacgccgtcgaggttacggacgtcgagaccgactccgacgccgtcggcggcgtccgtcgggtcggggacgtagggtaccacgggaccccgaaccggacccctaacccgtactacggtccctaccgtccgttaccccg

SEQ ID NO: 18328 - DNA, 629 bp, Homo sapiens
  misc_feature: GYAE6OF01C2W3G.14.70.G04.1.454.CMB.1.raw
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgctgcaaggtcgggccaggacggtcgcccctgaacccgtgaaacggcccaaagtcgaacgacccaaagacaggccaaggtgggttgtgagaccccgtgaggagcgtggccctggtcccaggcacgccgcgtcggccctgctgctcgcgtggtctggccagtcggcgcccagtcggcctcgctgccgacccgaagtcggttcgcgaccgacgaacggccgggacccacgacccgtggacgccgtcgacggttcggaacgtcgacgtacccgactcccgacgccgtacggccgggtacgccgtcggtcggggctagggtccgaacggtaccccgaaacggccccgtaaacccccgacgtaccgtccgtaccgtcccgttaccccg

SEQ ID NO: 18329 - DNA, 886 bp, Homo sapiens
  misc_feature: GYAE6OF01BCLH3.14.70.G04.1.454.CMB.1.raw
tcagcgtctagtaccacgaccggtgctcgatttagtgtagtgtgaagggaaaggggagggcagttggtagatgcccctctgggagagactccccgaggggtgacagccatggaccctggaagggccgtgggctagggacagggaccagagccagtccgagggagaggacagagccaagtggacgtggggtgtactgtaacacgccctgcgtggcgaggacgggaccgagggccaccgtcctccgagggacgcccagtgctgacgaacggtccgggaccaggacggtccgccccgtacggaacccgtacggaaaccggaccaaacgtacggaaccgaaacccgaaaggaaccgaacggaacccgtaagggttggggtttacggtacggaaccggacccccgttagggaacgggtacggtccggttccggggtccccggttccgggtaccccgacgggaccgacggccggtccggtcccggtccccgtcggtccgtcggtccgtcggtccggttcgggtccgtcggcccgtacggtccggtcccgtcccgtacggtccgggtccttcggccgtccggccccgtaacccgtaacggttcgggttaccggacccgaaacccggtaaccggaaacccggggccccgggtaaaccccgaccgggtaccccggtacgggacccgtacccggttaccggtaacgggttacggaaccgtaccggtaaccggtacccgtaccgtacccggaccgtcccggacgggacccggtaccgggtccgggtacggggtccggggtaccggtaccgggtacccggacccggaacccggaaccccggaacccccgtaacccgtaccgttacccgtacccttacccgttcccgttacccccccgg

SEQ ID NO: 18330 - DNA, 623 bp, Homo sapiens
  misc_feature: GYAE6OF01EES0H.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccgagggcaccgtcctccgagggagcccatgctgcaagtcggcagaggtcgccctgaacctttggaacgcaatgagacccaagacagccaagtggttgtgagcccgtaggaggagcgtaggccctcggtccaggcgagcgctcggccctgcgtgctgcgtcggtctcggcctagtcggtccgccgacgtcggcctcgtctcggccgcccgtaagtcggttcgacgtaaccgacgtaaacggccggggaacccacggtacccgtacggtacgtccgtacgtaggttacggaacgaccgagtaccgactccgacgccgtggcgtacggtccgtggtacgggtcgacgggtacgacggtacccgaacggacccgtaccccgaacgttcgtacccgtcttcccgtttccccgg

SEQ ID NO: 18331 - DNA, 640 bp, Homo sapiens
  misc_feature: GYAE6OF01D949L.14.70.G04.1.454.CMB.1.raw
  modified_base (346)..(346): a, c, t, g, unknown or other
  misc_feature (346)..(346): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaactgaagccaatgagacccaagacaggcaagtggtgtgagaccctgaggagcgtggccctggtcccaggcagcgcncggccctgctgctgctgggtctcggcagtcggtcgccgagtcggcctgctcgccgccgaagtggttcgcgaccgcgaaacggccggggacccacggaccccgtggaccgtacccgttcgaacggttacgggaacgtacgacggcccgaactcccgacgtcccgtggacccgggaacgtcccgggtcgggttcgggggacccgtaagggtccgaaccgggtacccccgaaaaccgggaccccctaaaccccccgtaacgtaccgtacccctaccgttcccggtttaccccccggg

SEQ ID NO: 18332 - DNA, 775 bp, Homo sapiens
  misc_feature: GYAE6OF01DB8H5.14.70.G04.1.454.CMB.1.raw
  modified_base (380)..(380): a, c, t, g, unknown or other
  misc_feature (380)..(380): n is a, c, g, or t
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagaggacagagccaatggacgtggggtgtactagtaacagccctgctggcgagagggaccagggccaccgtcctccgagggacgcccatgctgcaaggtcggccaggacggtcgcccctagaaaccgtggaaacggccaaatcgaacgaacccaagacgaggaccaaggttgggttgaggacgacccgtggaaggacgcggtcgggaccctcgggtacccngggacaggtccggcgtccggtccccgtgcgtggtctcggcgttcgggtctcggccgaggttccgggtcccaccgtacgtcgggtccctcggtccgtccggccggtacccgtaacggttcggtttaccggaaccggtaacccgaaccgggaaaccgggacccggggaaccccggtaccggtacccggtaccgggtaacccgtccggtaaccgtacgggttaacgggaaccggaccgaacggtacccgtacgtacccgaccggtccggtacggtaaccggcggtacccgggtgggtaccgggggtaccggacggtaccggacccggaacccgtaaccccgggaaccccaacccccggtaacgtacccgttaaccctacccgttcccgttacccccgg

SEQ ID NO: 18333 - DNA, 602 bp, Homo sapiens
  misc_feature: GYAE6OF01EBFUP.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagaggaccagggcaccgtcctccagggacgcccatgctgcaagtcgggccagaggtcgcccctgaacctgaaggccaatgagaccaagacaggccaagtgggttgtgagacccctgaggagcgtggccctggtcccaggcagcgctggcccctgctgctgctgggtctggcctagtcggtcgccctagtcggcctgctcgcgccaatggttcgcgaccgacgaaacggccggggaaccctacggacccgtggacgcccgtcaggttacggaacgccgaacggaccgtaacgtccgacgccgtacggcggtacgccgtgtcggggcgtagggtaccgacggacccgaaacgggacccctaaacccgaccgtacgtacctaccgtccgttaccccg

SEQ ID NO: 18334 - DNA, 654 bp, Homo sapiens
  misc_feature: GYAE6OF01DC3CE.14.70.G04.1.454.CMB.1.raw
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagactccccgaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaaggtcggccagacggtcgccctagaacctgaagccaatgaacgaccaagacaggaccaaggtggttgtgacgacccgtgaggagcgtcgggccctcgggtcccaggcacgcgcgtcggcccctgctcggtctcgtcggtcgggtccgtcggccgtacgtcggtccgccctacgtcggccgtcgcgtcgccgtaccgtaagtcggttcgaccgaaccgacggaaaaccggccggggaacccacggtacccgtacggaccgtcgtcgaggttacggaacgaccgtacggaccgacgtcccgaacgtccgacggccggacgccggtgggtacggggcgacgggtccgaccggacccgaaacggaccccaaacccgtacgtaccgtacctaccgttcccgttaccccg

SEQ ID NO: 18335 - DNA, 623 bp, Homo sapiens
  misc_feature: GYAE6OF01AYV7A.14.70.G04.1.454.CMB.1.raw
  modified_base (577)..(577): a, c, t, g, unknown or other
  misc_feature (577)..(577): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacgcccatgctgcaaggtcgggccagaggtcgcccctgaacctgaacggccaatgacgacccaagacaggccaagtgggttgtgacgacccctgaggagcgtcgggcccgtgggtcccaggcacgcgcgtcggcccctgctgctgcgtgggtctcggcctagtcggtccgcccgtagtcggtcctcggccgtcgccgtcccgaagttcgggttacgccgtaaccgacgaaacggcccggggaaccacgaacccggtggaacgtccgtacgaggttacggaacgtcgacgtccgactcccgaacgccgtcggacgtaccggccgtagggcgggcgacgggtacncgacccgaacgcccctaacccgctaccgtcctcctccgttaccccg

SEQ ID NO: 18336 - DNA, 718 bp, Homo sapiens
  misc_feature: GYAE6OF01D33X2.14.70.G04.1.454.CMB.1.raw
  modified_base (236)..(236): a, c, t, g, unknown or other
  misc_feature (236)..(236): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggancccatgctgcaagtcgggccagaggtcgcccctgaacctgaaggccaatgacgaaccaagacaggccaaggtgggttgtgacgaccccgtggaggagcgtcgggccctggtcccaggcagcgcgtcggccctgctgctgcgtgggtctcggcctagtcggtaccgcccgtagtcgggtccgtcgtccgttccggacccgtccccgaaagttcgggttacgacccgaaaccggaccgaaaccgggcccggggaacccccaacgggaccccgtacgggaccgtcccgtacgtaacgggttagggaacgtaccgacgggacccgtaacgtcccgaacggtcccgtcgggaccgggtaccggtcccggtcgggtacgggggtaccgtaacggggttaccgaaccgggtaacccccgaaaccgggacccccgtaaacccccgtaaccgttacccggtacccgtacccgttcccggtttaaccccccg

SEQ ID NO: 18337 - DNA, 649 bp, Homo sapiens
  misc_feature: GYAE6OF01E3RY1.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctggtcccaggcagcgctcggcccctgctgctgcgtgggtctcggcctagtcggtccgccctagtcggcctgcctcggccgcccgtaagttcggttcgccgaccgacgaaacgggccggggaaccccacggaccccgtgggaccgcccgtacgaggttacggaacgccgaacggacccgactcccgaacggtcccgtacggccgggacggcccgtgggtcgggggcctacggggtaccgaccgggacccccgaaaccgggaccccctaaacccccgtaccgtacggtccctaaccgttcccgtttacccccgg

SEQ ID NO: 18338 - DNA, 691 bp, Homo sapiens
  misc_feature: GYAE6OF01CN3YK.14.70.G04.1.454.CMB.1.raw
  modified_base (185)..(185): a, c, t, g, unknown or other
  misc_feature (185)..(185): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcagggngcccatgctgcaagtcgggccagaggtcnccctgaacctgaaggccaatgacgacccaagacaggaccaaggtgggttgtgacgacccgtgacggagcgtcgggccctcggtccgaggccagccgcgtcggcccctgctcgcgtgcgtggtctcggccagtcggtccgccgtagtcggtacctcgtccgtcggccgaccgtaagttcggtcgaccgaaccgacggaaaccggccgggacccaacggtacccgtacgggtaccgccgttacggacgttacggaacgtaccgacggccgtacgtacccgaggtcccgtacggaccgggtacggcccggttagggtaccgggtccggtaaccgggtccggaaacccgggtaccccgtaaacccgggtaccccgtaaacccccgtaccggttacccggtaacccgttcccgttcccggttaccccccggg

SEQ ID NO: 18339 - DNA, 624 bp, Homo sapiens
  misc_feature: GYAE6OF01ED8X3.14.70.G04.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (451)..(451): a, c, t, g, unknown or other
  misc_feature (451)..(451): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccaggaggtcgcccctgaacctgaacgccaatgagacccaagacaggccaagtgggttgngagacccctgaggagcgtgggccctggtcccaggcagcgctcggccctgctgctgctgggtctggcagtcggtccgccatcggcctgcctgccgccaagtcggtgccaccgcgaacggccgggacccacgcccgnggacgccctacgacggttcggaacgtcgacggacccgtactcccgacggcccgtggccggacggtcccggtgggtccgggggccgtaacggggtccgaaccgggacccccgaaaccgggaccccctaaacccccgtacgtacccgtaccgtacccgttcccgttacccccggg

SEQ ID NO: 18340 - DNA, 646 bp, Homo sapiens
  misc_feature: GYAE6OF01BFJMP.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggacggtcgcccctgaacctgaaggccaatgagacccaagacaggccaagtggttgtgacgacccctgaggagcgtgggccctggtcccagggcagcgctcggcccctgctgctgcgtgggtctcggccagtcggtccgcccgagtcggcctgctcgccgcccgagtcggttcgccgaccgacgaaccggccgggacccgacgaccccgtacggacgcctcgtacggttacggaacgtccgaacggcccgacgtcccgacggcccgtacgggccggtacggaccgttcgggtcgggggtccgacgggttcccgaccgggaccccggaaacccgggaccccgaaacccccgtacgtaccgtacccgtacccgttcccgttcccccgg

SEQ ID NO: 18341 - DNA, 628 bp, Homo sapiens
  misc_feature: GYAE6OF01DY3QR.14.70.G04.1.454.CMB.1.raw
  modified_base (613)..(613): a, c, t, g, unknown or other
  misc_feature (613)..(613): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccagggagaggacagagccaatggactggggtgtactgtaacagccctgctggcgagagggaccagggcaccgtcctccgagggagcccatgctgcaagtcgggccagaggtcgccctgaacctgaaggccaatgagaccaagacaggcaagtggtgtgacgacccgtgaggagcgtgggcccgtggtcccaggcagccgcgtcggccctgctgctgcgtgggtctcggcctagtcggtcgcccgagtcggccgtcgcctcgccgcccgtaagttcggttcgccgtaaccggaccgaaacgggcccgggaaccccgacggacccgtcggaacgcctcggagttacggaacgacgacggccgtacgtcccgacgtccgcggccgggacgaccggttggacggggcgtagggtcccgaaccggacccccgaaacggacccccgaaccccgtacgtcggtacccnccttccggtaccccg

SEQ ID NO: 18342 - DNA, 659 bp, Homo sapiens
  misc_feature: GYAE6OF01DAWCK.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagagtgcccctgaacctgaaggccaatgagacccaagacaggccaagtggtgtgagaccctgagagctggccctggtcccaggcagcgctggccctgctgctgcgtgggtctggcctagtcggtccgcccgatcggcctgctcgccgccccaaagtcgggttcgacgaacccggacgaaaacggccggggaacccgaacggtaccccgtcgggacgtccgtaccgtagggttacggaaagcccgaaaggtcccggaaacgtcccgaacggtcccgtacggtaccgggaacgtcccggttagggttccgggggccgtaacggggtcaacgggaccccccgaaaacgggtacccccaaaacccccgtaccgtacggttacccgtacccgttccgttacccccgg

SEQ ID NO: 18343 - DNA, 682 bp, Homo sapiens
  misc_feature: GYAE6OF01DUB57.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtcgcccctgaacctgaaggccaatgacaacccaagacacggccaaggtgggttgtgacgaccctggaggagcgtgggccctggtcccaggcagcgctcggccctgctgctgctgggtctggccagtcggtcgcccagtcggcctgccgtcggaccgcccgtaaagttcgggttacgaccgtaacccggaccggaaaccgggtccgggggaaacccccgtacggaaccccgttacggggaaccgtccccgttacgaacggtttacgggaaccgccgaacggcccggacttcccgaaggtccccgtagggcccggacggcccggtgggtcggggccgtaacggggtccaccgggacccccgaaaccgggacccccaaacccccgtaccgttacgttacccgtaccgttcccgtttacccccg

SEQ ID NO: 18344 - DNA, 648 bp, Homo sapiens
  misc_feature: GYAE6OF01EXN4P.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggttgtgagacccctggaggagcgtgggccctggtcccaggcagcgctcggcccctgctgctgcgtgggtctggcctagtcggtccgcccgtagtcgggccctggcccttcggccgaccccgtaagttcggttcgccgaccgtaccgaaacgggccggggaaccccacggacccctgggacgcccgtcgaacgttcgggaacgccgacggtccgactcccgacgcccgtggccgggacgtcccgggtggtgggggccctaggggttcccgaacgggacccccgaaaccgggaccccaaacccccggtacgttaccgccctacccgtccgtttacccccgg

SEQ ID NO: 18345 - DNA, 698 bp, Homo sapiens
  misc_feature: GYAE6OF01AZU7S.14.70.G04.1.454.CMB.1.raw
  modified_base (186)..(186): a, c, t, g, unknown or other
  misc_feature (186)..(186): n is a, c, g, or t
  modified_base (374)..(374): a, c, t, g, unknown or other
  misc_feature (374)..(374): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtntactgtaacagccctgctggcgaggagggaccagggcaccgtcctccgagggacgcccatcgctgcgaaggtcgggccaggacggtcgcccctgaacctggaacgccaatcgaacgaacccaagacgacggccaaggtgggtgtcgacggaccccgtggacggacgcgtcgggtcccgtcggtcccgnggacgacgcgcgtcggcccctgcctcgctcggcgtcgggtccgtggcctaggtcggtccgtcccgtagtcggtccgtcggtccgtccggcccgtacccgtaagttcgggttacgacccgtaaccggaaccggaaaccgggcccgggaacccaccgggtacccgtacggcgtaccgtacgtacggttcggaacgtcgaccgtacgaccgtccgacgtaccgcggaccgtacggtccggtaggggtccggcgtacgggtccgaaccggaccccgaaccgggaccccctaccgtcccgttaccgccgtaccgttcccgttacccccg

SEQ ID NO: 18346 - DNA, 615 bp, Homo sapiens
  misc_feature: GYAE6OF01BY649.14.70.G04.1.454.CMB.1.raw
  modified_base (239)..(239): a, c, t, g, unknown or other
  misc_feature (239)..(239): n is a, c, g, or t
  modified_base (477)..(477): a, c, t, g, unknown or other
  misc_feature (477)..(477): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacncccatgctgcaaggtcgggccaggaggtcgcccctgaacctgaaggccaatgagacccaagacaggccaagtgggttgtgacgacccgtgaggagcgtgggccctggtcccaggcagccgctcggcccctgctcgctgcgtgggtctggccagtcggtccgcccgagtcggcctgccgtcgccgccctaagtcggttcgccgaccgacgaacggccgggacccacgacccgtgggccnccgtacgacggtcggaacgccgacgccgtactccgacgccgtcggccgggacgtcccggtcgggtcggggcgtacgggtcgacggaccccgaaacgggccccaaccccgtacgtcgtaccctcgttcccgttccccgg

SEQ ID NO: 18347 - DNA, 704 bp, Homo sapiens
  misc_feature: GYAE6OF01DF2FU.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggagcccatgctgcaaggtcgggccaggacggtcgccccctgaaccctggaaacggccaaatgaacgacccaagacgaggaccgaaggtggggttgtgaacgaccccgtggacggagccgtcgggccctggtcccgaggccgacgcgcgtcggcccctgcgtgcgtcggcgtcgggtcgtcggccgtagtcggtccgcccgtagtcggtcctcgccgtcgccgaccccgtaagttcgggttcgaaccggaaccggaaaaaccgggacccggggaaccccgaacggaccccgtacgggaccgtcccgttacggtaacggtacggtaacgccgacggacccgtacgtacccgacgcccgtacggaccggacggtcccggtgggtcggggccgacggtccgaccggaccccgaaccgggaccccaaccccgtacgtacgtacccgtaccgttcccgtcccgttacccccccg

SEQ ID NO: 18348 - DNA, 825 bp, Homo sapiens
  misc_feature: GYAE6OF01CWSJI.14.70.G04.1.454.CMB.1.raw
tcagcgtctagtaccacgaccggtgctcgatttagtgtagtgtgaagggaaaggggagggcagttggtagatgcccctctgggagagatcccgaggggtgacagccatggaccctggaagggcctgggctagggacagggaccagagccagtccgagggagaggacagagccaatggactggggtgtactgtaacagcctgctggcgaggaggaccagggcaccgtcctcgagggacgcccatcgctgcaacggtcgggaccaggacggtcgcccctagaacctgaacggccaagtcgacgaacccaaagacgaacggaccgaaggttgggttgtcggaaccgaccccgtggacggacgcgtcgggaccctccgggtacccgacgggcacgccggccgtcggtccccgtcgtcgtcgtcgtcgtcggttcgggtccgtacggccgtacgtcggtcccggaccgtcggtccggtccgtcgtacgtccggtaccgtcccgtaacgttcggttccggtaccgaacccggaccggtaaaccggggaaccccggggaccccgtaaccggtaaccccgggtcgggaaccggtacccgttaccgtacggggtttaaccggaacggtacccggtaaccggtacccggtacgttaaccccggtaccgggcccggtccgggaacccgggtaccggtcccggttacgggggtcgggggacccggttaccgggtaacccggaaccgggtaccccccggaaaacccgggacccccgtaaaaccccccggtacgtttaccccggtaaccgttccccgtttacccccgtttcccccgggg

SEQ ID NO: 18349 - DNA, 639 bp, Homo sapiens
  misc_feature: GYAE6OF01B00BL.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggcaggagtgcccctgaacctgaacgccaatgagacccaagacaggccaagtgggttgtgacgaccccgtgaggagcgtcgggccctcggtcccaggcagccgcgtcggcccctgcctgcgtcgcgtcgggtctcggcctagtcggtccgcccgtagtcggccctgccgtcgccgccctaagtcggttcgccgaccgacgaaacgggccgggaacccacggaccccgtgggaccgtccgtacgtacggtaggaacgcgacgtccgactccgacgtcccgaggccggacggtccgtcgggtcggggcctagggtacccgaccggaccccgaaacggaccccctaaaccccgtacctaccggtacctcccgttcccgttaccccgg

SEQ ID NO: 18350 - DNA, 727 bp, Homo sapiens
  misc_feature: GYAE6OF01C0X1P.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtgcccctgaacctgaaggccaatgagacccaagacaggccaagtggtgtgagaccctgaggagcgtggcctggtcccaggcagcgctcggcccctgctgctgcgtgggtctcggccagtcgggtccgcccgagtcgggccgtcgccgtcggccggaccccgtaaacgttcgggtttcgacccgaacccggaccgaaaccgggacccgggggaacccccgaaccggacccccgttacggggaaccggccccgttacggtaacgggtttacgggaaacggtacccggacgggaccccggtaacgttaccccgaacgggtccccggttacgggaccccggggtaacggccccgggttacggggtcggggggtacccggtacgggttacccgaaccggacccccggaaacggacccccgaaacccccgtacccgtcggtaccccgtacccgttcccgtttacccccgg

SEQ ID NO: 18351 - DNA, 687 bp, Homo sapiens
  misc_feature: GYAE6OF01CPHK2.14.70.G04.1.454.CMB.1.raw
tcagcgtctagtaccacgaccggtgctcgatttagtgtagtgtgaagggaaaggggagggcagttggtagatgcccctctgggagagactccccgaggggtgacagccatggaccctggaagggcctgggctagggacagggaccagagccagtccagggagaggacagagccaatggacgtggggtgtactgtaacagccctgctggcgagagggaccagggccaccgtcctccgagggacgcccatgctgcaaggtcgggccaggaggtcgccccgtagaaccctgaacggcccaaatgaacgacccgaaagacaggaccaaaggtcggggttgtggacgaccccgtggaacggagccgtcgggcccttgggtccccagggcacggcgccgtcggcccctggctggcctggtccgtgggtctacggcctacgtcgggtccgcccgacgttcgggccctcggtccgtcgcccggacccgtaagttcggttaccgaccgtaacccggaccggaaaccgggacccgggtaaccccgacggaccccgtacgggccgtaccgtccgaaggttcggaacgtacggacgccgactcccgacgccgaggccggacgccgtggcggggtcgacggtacgaccggacccgaaaccggcccaaccccgtacgtaccgacctccgtccgttaccccg

SEQ ID NO: 18352 - DNA, 600 bp, Homo sapiens
  misc_feature: GYAE6OF01AKWQX.14.70.G04.1.454.CMB.1.raw
  modified_base (184)..(184): a, c, t, g, unknown or other
  misc_feature (184)..(184): n is a, c, g, or t
  modified_base (265)..(265): a, c, t, g, unknown or other
  misc_feature (265)..(265): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (526)..(526): a, c, t, g, unknown or other
  misc_feature (526)..(526): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
tcagcgtctagtaccacgaccggtgctcgatttagtgtagtgtgaagggaaaggggagggcagttggtagatgcccctctgggagagatccccaggggtgacagccatggaccctggagggcctgggctagggacagggaccagagccagtccagggagaggacagagccaatggactggggtntaactgtaacagccctgctggcgagagggaccagggcaccgtcctcagggagcccatgctagcaagtcgggccagaggtcnccctgaacctgaaggccaatgagacccaagacaggccaaggtgggttgtcggaacgaccccgtagaggacgccgtgggcccttgggtccccaggccagcgctcggccctgccgtgactggcctgggtctggaccntcgggtcncccgagtcggcctgctcgaccgtcccagttcggtcgaccgaccggacgaaacgggccgggaccctacggacccgtggacgccgtacgacggttcgaacgcctagcccgatccagtccnggccggtagcccgtagggtcgggactacgggcaacggtcccgacgcccgaaccnccgtgccnccgtcgtccccg

SEQ ID NO: 18353 - DNA, 630 bp, Homo sapiens
  misc_feature: GYAE6OF01CXMOJ.14.70.G04.1.454.CMB.1.raw
  modified_base (293)..(293): a, c, t, g, unknown or other
  misc_feature (293)..(293): n is a, c, g, or t
  modified_base (511)..(511): a, c, t, g, unknown or other
  misc_feature (511)..(511): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggactggggtgtactgtaacagccctgctggcgagaggaccagggccaccgtcctccgaggacgccatgctgcaaggtcgggaccagacggtcgcccctagaacctggaacggccaanggaacgacccaaagacgaaggaccaaaggtgggttagtaggacgacccctggaggacgcgtcgggccctcggtccgaggcagcgctcggccctgctgctgcgtggtctggccagtcggtccgccagtcggctcgctcgccgacctagtcggtacgcgaccgacgaaaccgggcgggaaccctacggtaccgcgacgtccgtacgacggttacggaacnccgacgaccgtaccgacgaccgacgtcggccggtacgcccggttagggccgggtcgagggtccgaccggaccccgaacggacccctaaccccgactaccgtccaccgtccgttccccgg

SEQ ID NO: 18354 - DNA, 629 bp, Homo sapiens
  misc_feature: GYAE6OF01BUJX8.14.70.G04.1.454.CMB.1.raw
  modified_base (185)..(185): a, c, t, g, unknown or other
  misc_feature (185)..(185): n is a, c, g, or t
  modified_base (524)..(524): a, c, t, g, unknown or other
  misc_feature (524)..(524): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcgagggacgcccatgctgcaaggtcggccagaggtcgcccctgaacctgaacggccaatcgacgacccaagacaggccaagtgggttgtgacgaccccgtgacggagcgtcgggcctgggtcccgaggcacggcgctcggccctgctgctggctgggtctcggcagtcggtccgccgacgtcggctgctcgccgtcctaagtcggttcgccgtaccgacgaaacgggccgggaacccacggaccctcgggacgtcccgtacgacggttacggaacgacggtacgaccggtaaccnccgacggtccgcggacgggacgtccgtgggcggggtcctaggtaccggacgacccgaacccggacccaaaccccgtagtacccgtctacccgtccgttaccccgg

SEQ ID NO: 18355 - DNA, 556 bp, Homo sapiens
  misc_feature: GYAE6OF01CGBDV.14.70.G04.1.454.CMB.1.raw
  modified_base (497)..(497): a, c, t, g, unknown or other
  misc_feature (497)..(497): n is a, c, g, or t
  modified_base (546)..(546): a, c, t, g, unknown or other
  misc_feature (546)..(546): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgacgaccctgaggagctgggccctggcccaggcagcgctcggccctgctgctgcgtgggtctggccagtcggtcgcccagtcggcctgctcgccgccaagtcggtcgcaccgcgaacggccgggaccacgcccgtggacgcctcgagttcggaacgcgacgaccgacgtccacgccgtcggcggngccgtggtcgggcgaggtcgacgcccgaacggcccaacccacacgtccncgtcgtcccg

SEQ ID NO: 18356 - DNA, 785 bp, Homo sapiens
  misc_feature: GYAE6OF01CNSUT.14.70.G04.1.454.CMB.1.raw
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggacgtggggtgtactgtaacagccctgctggcgaggagggaccagggcaccgtcctccgagggacgcccatcgctgacaaggtccgggccgaggacggtcgcccctaggaacccgtaggaaacggccaaagtacggaacgaaccccgaaagaccgaacgggaccgtaaagggtggggttacgtacggaaccggtaccccgtagggaacggacggccggtcggggtcccgttcggggtacccccgaggggccgacggtccggtcccgtccgggcccccgttaggccgtcggccgtcggtccggttcggggttccggtcgggtacccgtacggttcggggttcccgcccgtacggtccgggtcctcggccgtcggaccgtacccgtaaggttcgggttaccgacgtacccggaaccggaaaccgggcccggggaaccccgacggacccggtcgggacgtcccggtacgtacgggtacggacggacctaacggcccgtacgtcccgacgccgtacggcggtaccggccggttgggcgggacgtacgggtacccgacggaccccgaaccggtaccccgaacccgtacgtaccgtccctccgttcccggttccccg

SEQ ID NO: 18357 - DNA, 641 bp, Homo sapiens
  misc_feature: GYAE6OF01EQ5IN.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaaggtcgggccaggaggtcgcccctgaacctgaacggccaagtgacgacccaagacaggaccaagtgggttgtgacgacccgtggaggagcgtcgggccctcggtcccgaggcagccgctcggccctgctgctgcgtcggtctcggcctagtcggtccgcccgtagtcgggccttcgccgttcgccgtaccccgtaagttccggttcgccgtaaccgaccggaaaccgggcccggggaacccacgggtaccccgtggaccggtaccctcgaaggttcggaacgccgacgtccgaactccgacgtccgtggccggtacgtccggtggtcgggcgacggcgaccggacccgaacggacccctaccccacgtccgacctacgtcccgttacccg

SEQ ID NO: 18358 - DNA, 613 bp, Homo sapiens
  misc_feature: GYAE6OF01BE086.14.70.G04.1.454.CMB.1.raw
tcagcgtctagtaccacgaccggtgctcgatttagtgtagtgtgaagggaaaggggaggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgccccgtgaacctgaacggccaatgaacgaacccaagacaacggccgaagtgggttgtgacgacccctggaggagcgtggcccgtggtcccgaggcagcgctcggccctgctgctgcgtggtctgctagtcggtcgccgagtcggcctcgcgtcgccgccgtaagttcggttcgaccacggacgaacgggtccgggaacccgacgacccgtcggacgtccgtacggtacgttcggaacgtcgaaccgtccgacgtccgacgccgtcggccgacgtccgtgggtcggggctacggtcgaccggcccgaaaccggccccgaaccctaccgtacgtccacgttccctaccccg

SEQ ID NO: 18359 - DNA, 619 bp, Homo sapiens
  misc_feature: GYAE6OF01B82KK.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctcgcaaggtccgggccaggacggtcgcccctagaaccctgaaacgggcccaaatcgaagaacccaaggaccaagggcccaaagtggggttgtggacgacccctgaggagcgtgggcctggtcccaggcagcgctcggccctgctgctgcgtgggtctcggcagtcggcgcccagtcggcctagcgtcgccgaccagtggtcgcaccgcaaggccgggacccacgaccgtggacgccttagacgttcgaacgccgacgccgatccgacgtccgtaggccggtacgccggtagggcgggggctaggggtccaaccggtacccgaaacggtcccccgaaacccgacttacggaccctaaccgttcccgttaaccccgg

SEQ ID NO: 18360 - DNA, 642 bp, Homo sapiens
  misc_feature: GYAE6OF01D9E0F.14.70.G04.1.454.CMB.1.raw
  modified_base (478)..(478): a, c, t, g, unknown or other
  misc_feature (478)..(478): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcggcagaggtcgccctgaacctgaacggccaagtgaacgacccaagacaggaccaaaggtgggttgtaggacgaccccgtggacggagccgtcgggcccgtggtccccgaggccagcgctcggccctgcgtgctggcgtggtctggctagtcggcgccagtcggctgctcgctccgtagtcggtcgcgaccgacgaacgggccggaccgacgacccgtcggacnccgtacgacggttacggacggtaccgacggaccgtacgtccgaggcccgtgggccggtaccggccggtcgggcggggtacgtacgggtaccgacccgggacccggtaaacccgggccccctaaacccggtcctaccgttacccgaccgttcccggttaaccccg

SEQ ID NO: 18361 - DNA, 677 bp, Homo sapiens
  misc_feature: GYAE6OF01EP34V.14.70.G04.1.454.CMB.1.raw
  modified_base (238)..(238): a, c, t, g, unknown or other
  misc_feature (238)..(238): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccagaggtcgccctgaacctgaaggccaatgagacccaagacaggccaagtgggttgtgacgaccctgaggagcgtcgggccctggtcccaggcacgcgcgtcggccctgctgctcgcgtgggtctggccgtagtcggtaccgcccgagttcggcccgttgccgttcggccgtcccgtaagttcgggttacgccgtaaccggaccggtaacgggacccggggaaccccgacggaccccgtacgggaccgcccgttacgacgggttacggaacggccgacggtacccgacgtacccgacgcccgtcggccgggacggtccggtacgggtcggggccgacggggtccgaaccgggaccccgaaacccgggacccccgaaacccccgtaccgtaccgtaccctacccgtcccgtttacccccgg

SEQ ID NO: 18362 - DNA, 744 bp, Homo sapiens
  misc_feature: GYAE6OF01E19XT.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggacncccatcgctgcaaggtcgggccaggacggtcgcccccgtaggaacctaggaacgggaccaaagtacggaacgaacccgaaacggaaccgaacggacccgaagggttcggggtttaggtacgggaccggtaccccgtaggacgggaggtccggtccggggtcccgtcgggtacccgacggcgaccggccggtccgtccggtccccgtcgtccgtcggccgttcggtcgttcgggtccgtcggtcgtacggtcggtccgcccgtacgtcggccgttcgccgtccgaccgtccgtaacgttcggtaccgccgtaaccggaccggaaccgggccgggaacccgaccgtacccgacggacgtcccgttacgtaggtacggaacgaccgtacgaccgtacgtccgacgtccgacggcggacgtccggtagggtacggggtccgtacggtaccgaccgtaccccggaaacggacccaacccggtactaccgtacctccgtcccgttccccg

SEQ ID NO: 18363 - DNA, 723 bp, Homo sapiens
  misc_feature: GYAE6OF01BLYQW.14.70.G04.1.454.CMB.1.raw
  modified_base (239)..(239): a, c, t, g, unknown or other
  misc_feature (239)..(239): n is a, c, g, or t
  modified_base (624)..(624): a, c, t, g, unknown or other
  misc_feature (624)..(624): n is a, c, g, or t
  modified_base (706)..(706): a, c, t, g, unknown or other
  misc_feature (706)..(706): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcggccagacggtcgccctagaacctgaacggccaaagtcgaacgaaccccaaaggaccagggaccgaaaggttggggttagtaggaacggacccctggacggacgccggtcgggccccgtaggtcccccgagggaccgaggccgacggtcgggtccccctggccgttcggccgttcggtccgttggggtccgttcgggcccgtaggtcgggtaccgcccgtacgttcgggcccgtggtccgtcggcccgaccccgtaaggttcggttacgaccgtacccggaccggaaaccgggcccgggaacccgaaccggtacccgcggaccgccgtacgtacggttacggacgtccgaacgccgactcgacgtccgnggaccggacgccggtagggtcggggaccgtagggtccgaaccggacccgaaacggaccccgaaacccctacgtacccgtacncccgttccgttccccgg

SEQ ID NO: 18364 - DNA, 618 bp, Homo sapiens
  misc_feature: GYAE6OF01ALNEA.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaaggtcgggccaggaggtcgcccctgaacctgaaggccaatgagaccaagacaggccaagtggtgtgacgaccctgaggagcgtcgggccctcggtcccaggcacgcgcgtcggcccctgcctgctgcgtgggtctggccagtcggtccgcccgtagtcggcctggcctcggaccgtccccgtaagtcggttacgcctaaccggacgaaacgggccgggtaacccgacgacccgtggacgcccgtacgacggttacggaacgcgacgggccgacgtccgaacgccgtcgcggcgccgtcgggcgggccagggccgaacgcccgtaaaccggccccaaacccgtactaccggtccaccgttccgttaccccg

SEQ ID NO: 18365 - DNA, 604 bp, Homo sapiens
  misc_feature: GYAE6OF01CWIC6.14.70.G04.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (555)..(555): a, c, t, g, unknown or other
  misc_feature (555)..(555): n is a, c, g, or t
  modified_base (591)..(591): a, c, t, g, unknown or other
  misc_feature (591)..(591): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagaccaatggactggggtgtactgtaacngccctgctggcgagacggaccagggcaccgtcnccgagggacgcccatgctgccaagtcgggccaggaggtcncccctagaacctgaaggccaatgaagacccaaagacaggaccaaggtggttgtagacgacccgtggacggagaccgtcggcctcggtccgacggcgacgccggctcggcccctgctcgctcgcgtggtcgtcggccacgtcggtccgccgacgtcggtcctcggctcggccgtacccgtagtcgttcgacgaccgacgaacgggcggtaaccacgaccgtcggacgctacgaggtagacgtcgaacgcgacgtccagccgtggaccggacgccgtaggtcgggacgngtaccgcgacccgacgaccccaaccgtacacgtccncttccgtaccccg

SEQ ID NO: 18366 - DNA, 717 bp, Homo sapiens
  misc_feature: GYAE6OF01CWKG4.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggcgcccctgaacctgaagccaatgacgacccaagacaggacagtggtgtgacgacccgtgacggagcgtcgggccctcgggtcccgaggccaggccgccgtcggccccttggcctcggtcctcggtcgttggggtcctcgggcccgtaggtccgggtaccgccccgtagttccgggcccgttggtcccgttcggtccggtaccccgtaaggttcgggttacggacccgaacccggtaccggaaaccgggaccccggggtaaccccgaccgggaccccgtagggaccgtacccgttaccggtaacggttacgggaacggcgaacccgggtccgacctccgaacggtcccgcggtaccggcggtcccggtgggtccggggcgtacgggtacccgaccgggacccgaacccgggaccccaaccccgtacgtccggtacctaccgttccgttacccccg

SEQ ID NO: 18367 - DNA, 751 bp, Homo sapiens
  misc_feature: GYAE6OF01D5DKK.14.70.G04.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (265)..(265): a, c, t, g, unknown or other
  misc_feature (265)..(265): n is a, c, g, or t
tcagcgtctagtaccacgaccggtgctcgatttagtgtagtgtgaagggaaaggggagggcagttggtagatgcccctctgggagagatccccaggggtgacagccatggaccctggagggcctgggctagggacagggaccagagccagtccagggagaggacagagccaatggacnggggtntactgtaacagccctgctggcgagaggaccgagggcaccgtcctaccgagggacgcccatgctgcgagtcggcagaggtcnccctgaacctgaacgccaatgaacgaccaagacacggaccaaggtgggttagtacggcggaccccgtaggacgggagtccgtcgggccctagggtcccgaggccgtaacgccgtaccgtcggccccgtagacgtcgactgtcgtagggtcctgggacctaggtccgggtcccgacccgtagttccgggccgtacggtccgtcccggtaccggtacccgtaacggttcggttaccgacccgtaaccggtaaccggaaaccgggtaccggggaaccccacggtaccccggtacggccggtaccgttacggaacggttaccggaaccggtacggacggtacccggtaccttaccgaccggtaccggtacgggccggtacgggtccggtaggggtacggggaccggtagggtaccggtacgggaccccggaaacggaccccgtaaacccggtacgttaccgtacccggttaaccgtcccgttaccccggg

SEQ ID NO: 18368 - DNA, 702 bp, Homo sapiens
  misc_feature: GYAE6OF01C61JG.14.70.G04.1.454.CMB.1.raw
  modified_base (274)..(274): a, c, t, g, unknown or other
  misc_feature (274)..(274): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagacgggaccagggcacccgtcctccgagggacgcccatcgctgacaaggtcgggccagacggtcncccctagaaccctgaacggccaagtcgaacgacccaagacgaggccaaggtggtgtagacgacccgtgaggacgcgtcgggccctcggtcccaggcgacgcgcgtcggccctgcctgcgtggtcgtcgggtctcggcctagtcggtccgcccagtcggtcctggcctcggccgtaccgtagtcggttacgccgtaccgacggaaccgggccggggaaccccacggacccgtacggaccgtccgtaccgtaggttaggaaccggtccgaacgggtcccgtaacgccccgaacggtcccgtacggtccgggtacgtccccgggttgggccgggggtaaccgtacgggtacccggaccggtacccccggaaaccggtacccccgaaacccccgtacgttacccggttacccaccgttcccgttaccccccg

SEQ ID NO: 18369 - DNA, 713 bp, Homo sapiens
  misc_feature: GYAE6OF01AFISS.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggccaggaggtcgcccctgaacctggaacggcccaatgaacgacccaagacaggccaaaggtggttgtgacgaccccgtggacggagcgtcgggccctcggtcccgaggcacggcgctcggcccctgcctgctcgcgtgggtctggcctagtgggtccgcccgtagtcggcctggtcctcggcccgtcccgaacgttcgggtcgtaccgacccggtaaccgaaacgggtcccggggaaccccgtaaccgggaaccccgtacggggacctcccgtaccgtaacgggtttcggaaacggccgaaccggtacccggactacccggaacgtcccgtacggccggtagtccccgggtgggttaccggggcgtacgggtacccgaccggtacccccggaaacggaccccccgtaaaacccccggtaccgtaaccgtaccctacccggttccctttaccccccggg

SEQ ID NO: 18370 - DNA, 621 bp, Homo sapiens
  misc_feature: GYAE6OF01B4H82.14.70.G04.1.454.CMB.1.raw
  modified_base (378)..(378): a, c, t, g, unknown or other
  misc_feature (378)..(378): n is a, c, g, or t
  modified_base (503)..(503): a, c, t, g, unknown or other
  misc_feature (503)..(503): n is a, c, g, or t
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagaggacagagccaatggacgtggggtgtactgtaacagccctgctggcgagagggaccagggcaccgtcctaccgagggacgcccatgctgcagtcggcagaggtcgccctgaacctgaacggccaatcgaacgacccaagaccgaggaccgaagtggggttgtggacgaccccgtgacggagcgtggcccgtcggtcccaggcagccgctcggcccngcctgcctggcgttgggtcgtcggtcctacgtcggtccgaccctcgtcggccttcggcctcggccgaccgtaagttcgggtctccgacgaccgaacgggacccggaccgacgaccccgagggccnccgtacgtaggtacgacgcgacggccaagtcccacgccgcgccgggactccggtggtcgggccgtaggcccggacgccccgaacgcccgacccacggtcaaccgtccgtctacccccg

SEQ ID NO: 18371 - DNA, 689 bp, Homo sapiens
  misc_feature: GYAE6OF01C1RDH.14.70.G04.1.454.CMB.1.raw
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggacgtggggtgtactgtaacagccctgctggcgagaggaccaggcaccgtcctccgagggagcccatgctgcaaggtcgggccaggaggtcgcccctgaacctgaacggccaatcgaacgacccaaagacgaggaccgaaggtgggttgtagacgacccgtgaggacgcgtcgggccctcggtcccgaggcgacgccgcgtcggcccctgctcgcgtcgtcgtcgggtctggtcctagtcgggtccgcccgagtcggccgtcgcgtcgcccgaccgtaagttcggtcgaccgaccggaacgaaaccgggcccgggaacccaccggacccgtacggaccgtcctacgtacggttacggaacgtccgaaccggtaccgacgtacccgacggccgtaccggcgggtaccggtccggtagggtaccggggacgtaccgggtaccgacccgggaccccggaaacccgggacccctaaaccccgtacgttaccgtcccgtacccgttcccgttacccccgg

SEQ ID NO: 18372 - DNA, 577 bp, Homo sapiens
  misc_feature: GYAE6OF01A7Y5U.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagaccctgaggagctgggccctggtcccaggcagcgctcggccctgctgctgctgggtctggcagtcggtcgcccatcggcctgctcgcgcccgaatcggttcgctaccggacgaacggtccggggaacccacggaccccgtggacgccctcgaggttcggaacgcgacgcccgatcccgagcccgtggccggagccgtggtcgggcaggtcgacggacccgaacggccccaaaccccgcgtacgcctaccgtccgttaccccg

SEQ ID NO: 18373 - DNA, 672 bp, Homo sapiens
  misc_feature: GYAE6OF01AQKXE.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctgaacctgaaggccaatgagacccaagacaggccaaggtggttgtgacgaccccgtggacggagcgtcgggccctggtcccaggcagccgcgtcggcccctgctgctgcgtgggtctggcctagtcggtcgcccgagtcggtccgtgccgtcggccgtacccgtaacgttcggttcgccgtaaccgaccgaaacgggccggggaaccccacggaccccgtggaccgcccgtcgtaggttcgggaacgtccgacgtacccgacgttcccgacgcccgtcggaccggcggtcccggtagggtcgggggtccgtacggggtaccgacccgggaccccgaaaccgggtaccccccaaacccccgtacgtacccgtaccccgtaacccgttcccgtttaaccccccgg

SEQ ID NO: 18374 - DNA, 740 bp, Homo sapiens
  misc_feature: GYAE6OF01BN3XU.14.70.G04.1.454.CMB.1.raw
  modified_base (312)..(312): a, c, t, g, unknown or other
  misc_feature (312)..(312): n is a, c, g, or t
  modified_base (385)..(385): a, c, t, g, unknown or other
  misc_feature (385)..(385): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtcgccctgaacctgaaggccaatgagaccaagacagccaagtggttgngacgaccctgaggacgcgtgggcccgtggtcccgaggcgagccgctcggcccctgcgtcgctcgcgtgggtcncggcctacgtcgtccgcccgtacgtcggtccgtgccgttcggaccgtacccgtaaaggttcgggttaccggtaccgaacccggtacccggtaaaacgggcccgggggtaacccccgaacgggtaacccccggttagggacccggtaccccgttaccgggtaagggttaccggggaaacggacccgtaacgggacccggtaaccggttccccgaaccggtcccggtacgggcccgggtaacggtccgggttacggggtacgggggaccgtacggggtaccgtaaccggaccccgaaaccgggtacccccgaaaccccgtaccgtaccggtacccttaccgttcccttacccccggg

SEQ ID NO: 18375 - DNA, 602 bp, Homo sapiens
  misc_feature: GYAE6OF01B4IYU.14.70.G04.1.454.CMB.1.raw
  modified_base (265)..(265): a, c, t, g, unknown or other
  misc_feature (265)..(265): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggagcccatgctgcaagtcgggccagaggtnccctgaacctgaacggccaatgacgaccaagacaggccaagtgggttgtgacgaccccgtggacggacgcgtagggccctggtccccgaggccagcgccgtggcccctgccgtgcgtgcgtcgggtctggccagtcggtcgccgagtcggccgtgctcgcgccaagtcgtgcacgacgaacgcgggaccacgacccgtggacgcgtcgaggtacgagcgagtccgacgtccgacgccgtacggccggtacggccgtcgggtcgggcgtacgggacgtaccggacccgaacggaccccgtaaccccgtaccgtaccgtccgtaccgtccgttaccccg

SEQ ID NO: 18376 - DNA, 897 bp, Homo sapiens
  misc_feature: GYAE6OF01D9HHQ.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatgggactggggtgtactgtaacagccctgctggcgagagggaccagggcaccgtcctccgagggacncccaatgctgcgaaggtccgggccaggtacggtcgccccgtagaaccgtacggaacggcctaaagtacggaacgaacccgaaacggaacgaacggacccgtaaaggttcgggggtttacggtacggaccggtacccccgttaggacgggtaacggtccgtacggggtaccccgttacgggtaccccgacgggtccgaacggtccgtcccggtcccggcccccgttggtcccgtggtccgttcggtcggttcgggttccgtcggtacccgtagtaccgggttccgacccgtacggtccgggtcccgttcggcccgttcggtacccggtacccgtaaacgggttccgggttaccgacccggaaacccggtaacgggtaaaccgggaccccgggggtaaaccccgtaaccgggtaccccggtacggggtaacccgttcccggtaaccggtaacggttaacgggaaccgacccggtacggtaacccggtaacgtacccggaccgtcccggttaacgggcccggttacgggcccggttacggggtaccggggaccgtacggggtacccggaacccgggaacccccgtaaaccggggtaacccccctaaacccggttacccgttaccggaacccgtttcccgtaccccgggttttacccccgg

SEQ ID NO: 18377 - DNA, 684 bp, Homo sapiens
  misc_feature: GYAE6OF01B2Q1K.14.70.G04.1.454.CMB.1.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggccaccgtcctccgagggacncccatgctgacaaggtccggcagaggtcncccctgaacctgaacgcaatgacaccaagacagccaaggtggtgtgacgtaccctggagacgcgtcgggcccgtggtcccgagcacggcgcgtcggccctgctgctggccgtggtcctcggccgtagtcggtccgacccgtgtcggccgtgacgtcgccgtacccgtagtcggtcgaccgtaaccgacggaaaccgggcccgggaaccccgacgtaaccccgggtcggtaccgccgttacgacgggttacggaaccgtaccggacggtacccggacgtacccgacggaccggtcggaccggtacggtccggacggggttcggggccgtacgggtaccgacccggaaccccggtaaaccggaccccctaaccccggtacaccgggttaccctaccgttccccgttacccccggg

SEQ ID NO: 18378 - DNA, 607 bp, Homo sapiens
  misc_feature: GYAE6OF01DJDCG.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgacgacccaagacaggccaagtgggttgtgagacccgtgaggagcgtgggccctggtcccaggcagcgcgtggccctgctgctgcgtgggtctggccagtcggtccgccagtcggctgctcgcgccagtggttcgcaccgacgaacggccggggaaccccacggacccgtcgggacgcccgtcgacggttacggaagccgacgccgactcccgacggcccgtggaccggtacgcccggtggtcgggggacgacgggttaccgaccggaccccgaacggaccccctaaccccgactacgtccctaccgttccgttaccccgg

SEQ ID NO: 18379 - DNA, 749 bp, Homo sapiens
  misc_feature: GYAE6OF01DT4TI.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggacgggaccaggaccacccgtcctccgagggacgcccatgctgcgaacggtccgggaccaggacggtccgcccctagaacctggaacgccaaatcggaacgaacccaagacgacggcctaaggtgggttagagacgacccgtggacggacggcgtccgggccctcggtacccgacggccgacgccggccgtcggccccgtgccgtcgtccgtcggtccgtcgggtccgtcggtccgtaggtcccggtcccgcccgtacggtccgggtcccttcggcccgttcggaccccggtacccgttaacggttccgggttaccgaccgtaacccgggaaccggaaacccgggacccgggggaaccccaccgggacccggtacgggcccgtaccgtacggtacggtacggaaccggccgtaaccggtacccgtacgtccgacggtcccgcgggaccggacggtccggtgggtaccgggccgtacggaccggacccgaacccggaacccgaccctaacccgcgtaccgtacctcctcccgttaccccg

SEQ ID NO: 18380 - DNA, 596 bp, Homo sapiens
  misc_feature: GYAE6OF01DYT7Y.14.70.G04.1.454.CMB.1.raw
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
tcagcgtctagtaccacgaccggtgctcgatttagtgtagtgtgaagggaaaagggagggcagttggtagatgcccctctgggagagatccccgaggggtgacagccatggaccctggaagggcctgggctagggacagggaccagagccagtccagggagaggacagagccaatggactggggtgtactgtaaacagccctgctggcgagagggaccagggcaccgtcctccagggacgcccatgctgcaagtcgggccagaggtcgcccctgaacctgaaggccaatgacgacccaagacaggccaagtgggttgtgacgaccctgaggagcgtgggccctggtcccaggcagcgctcggccctgctgctgctgggtctcggccagtcgtcgcccagtcggcctgcncgcgcccaagtggttanccgaccgccgaaacggccgggacccagacccgtcgggacnccgttcgagttaggaacgtcgagcccgactccacggcctgccggagtcccgtggtcggggaccgtagggtccacggacccgtaacggacccccgtaacccgaccgtcgacccgtcgttccgttaccccgg

SEQ ID NO: 18381 - DNA, 741 bp, Homo sapiens
  misc_feature: GYAE6OF01CY9KU.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatcgctgcgaagtcgggccaggaggtcgcccctagaacctggaaggccaatcgaacgaacccaaagaccacggaccaaggtcggggttagtaggaccgtacccccgtaggagggacggtaccggtcgggcccgttcgggtccccgagggccgacggccggacgtccggccccctgccgtgtccgtcggtcgttcgggtccgtcggccctaggttcgggtcccgcccgtaggtccgggtcccttcggccgttccggacccgtacccgtaagttccgggttcgaccgaaacccggaccggaaaccgggacccggggaacccgaacggtaccccgtacgggaccgtcccgtacgtacggttacggaacgccgacgaccgacgtacccgacgtccgtcggaccggacggcccggtgggtcggggaccgtagggccgaaccggaccccgaaaccggacccccaacccgtaccgttaccgtaccctcccggttccgttacccccgg

SEQ ID NO: 18382 - DNA, 645 bp, Homo sapiens
  misc_feature: GYAE6OF01A1M1S.14.70.G04.1.454.CMB.1.raw
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggacgcccatgctgcaaggtcgggccaggaggtcgcccctgaacctgaacgccaatgacgacccaagacgaggccaaggtggttgtgacgacccgtggaggagcgtcgggcccgtcggtcccgaggcacgcgccgtcggcccctgcgtncggggggtcncgtcgggtctcggcctgtcggtcgcctgtcgcgtgcgtcgccgacctagtcggtcgcaccgacgaacggccgggacccgacggtacccgtcgggacgtccgtacgtacggttcggaacgcgacgcccgacgcccgagccgtcggaccggcgtccggtcgggtcggggccgtacgggtccgacccggaccccgaaacccgggtacccccgaaccctacggtaccctacccttacccgttcccgttacccccg

SEQ ID NO: 18383 - DNA, 554 bp, Homo sapiens
  misc_feature: GYAE6OF01EK023.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctcggccctgctgctgctgggtctggccagtggtcgcccatcggcctgctgcgcccagtgtgcacgcaagccgggacccacgacccgtggacgcctcgagttggaacgcgagccgatccagcccgtggccggagcccgtggtcggggcgaggtcgacggccccgaaggccccaacccgactacgtcctaccgtcgttccccgg

SEQ ID NO: 18384 - DNA, 738 bp, Homo sapiens
  misc_feature: GYAE6OF01DXXJA.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggcaccgtcctccgagggacgcccatgctgacgaagtcgggccaggacggtcgcccctagaacctggaacggccaaagtcgaacgaaccccaaagaacgaacggaccgaaaggttgggttgtaggacgacccccgtaggaggacggccggtacggggcccgtcgggtccccgagggccacggccggtccgtcggccccgtggccgtcgcgtcggtcgttcgggtcgtcggccagttcgggtccgcccgtacgtcggtccgtcgtccgtcggcccgtcccgtaagttcgggttacgtacccaaccggaccgaaacgggcccggggaacccgaccggtaccccgtgggaccgtaccgtacggacggtacgggaacgcgaacgcccggtaacgttcccgacggtcccgtcgggtacccggacgtcccggtaggggtccggggccgtaagggtcccgaaccggaccccgaaccgggacccccaaccccgtaaccgtctaccgacccgttccgttccccccgg

SEQ ID NO: 18385 - DNA, 611 bp, Homo sapiens
  misc_feature: GYAE6OF01EGM8A.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggacaccgtcctccagggagcccatgctgcaagtcgggccagaggtgcccctgaacctgaaggccaatgagacccaagacaggccaagtgggttgtgagacccctgaggagctgggccctggtcccaggcagcgctcggcccctgctgctggctgggtctggccagtcggtccgcccgtagtcggcctgccgtcgccgccctaagtcggttcgcctaccgacgaacggccggggacccacggacccgtggacgcctcgacggttcggaagccgagccgtactcccgagcccgtaggccgggacgcccgtggtcgggggtccaggggtccgacggaccccgaaacggacccccgaaacccccgacctaccgtaccctacccgtccgttaccccgg

SEQ ID NO: 18386 - DNA, 937 bp, Homo sapiens
  misc_feature: GYAE6OF01CK31Y.14.70.G04.1.454.CMB.1.raw
  modified_base (186)..(186): a, c, t, g, unknown or other
  misc_feature (186)..(186): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtntactagtaacagccctgctggcgagaggaccagggcaccgtcctcgagggacgcccatcgctgcaaggtcggaccaggacggtcgccccgtagaaccgtggaacggtacccaagtacggaacgaacccgaaaggaaccgaacgggacccgtaaagggttgggggtttacggttacgggaaccggtaaccccccgttagggaacggggacggtacccggttccgggggtacccgttcggggttacccccgaagggaccgaacggccggtccgttccgggccccccgttggccgttcggcccgttacggtccgtttcggggttacctacgggtacccgtaacggtttccggggtacccggtacccccgtaaggttcccgggtacccgttcggtacccggtttaccggacccccgtaacccccggttaaagtttacgggtttacccgacccggtaaacccggaccgggaaacccggggtacccggggggaaaccccctaaccgggtaacccccggttacgggaacccggtaccccgtttaacgggtacgggtttaacgggaaccggtaccgtaaccgggaccgtaccgtacccggacggtacccgtcgggaccggtacggtcccgggttacggggtacgggggaccttaaccggggccggtaacccggaacccccgggtaaaccggtaccccccgtaaaccccggtaaaccgttcccgtaacccggtacccgtttcccgtttaaccccccgggg

SEQ ID NO: 18387 - DNA, 697 bp, Homo sapiens
  misc_feature: GYAE6OF01ELGWF.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccgagggagcccatgctgcaaggtcgggccagaggtcgcccctgaacctgaaggccaatgacgacccaagacaggccaagtggttgtgagaccctgaggagctgggccctggtcccgaggcacgcgctcggccctgcctgctgctgggtctggcctagtcggtcgccagtcggcctgctcggccgcccgtaagtcggttcgaccgtaccggacgaaacgggtccggggaaccccacgggtaccccgtcggacgtcccgtacggtaacggttacgggaacgaccgtacgggaccccggaacgtccccgaacggtcccgttacgggacccgggtacggtcccggttaggggtccgggggaccgtaccgggggtacccgtacgggaaccccccgtaaacggggacccccccgtaaaacccccggtaccgttaccggtaccccttacccgttccccggtttaccccccggg

SEQ ID NO: 18388 - DNA, 683 bp, Homo sapiens
  misc_feature: GYAE6OF01CJU5U.14.70.G04.1.454.CMB.1.raw
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgacaaggtcgggccaggaggtcgccccgtagaacctgaacggccaatgagacccaagacaggccaagtgggttgtgagaccccgtgaggagcgtgggccctggtcccaggcacgcgcgtggcccctgctgctgcgtggtctcggcagtcggtcgcccagtcggcctcgccgttgcccgtacccgtaaaggttcggttcgaccgtaccggacgaaacgggccggggaacccacggacccgtggacgtccgtacgtaggttacggaacgccgaacgtccgaaccttaccggaacgtcccgttacgggccgggaaccggtccggtcgggtacgggggtacccgaaggggttcccgaacccgggaccccggaaaccgggacccccgtaaaacccccgtaccggtaccgtacccttaacccgtccggtttacccccccggg

SEQ ID NO: 18389 - DNA, 774 bp, Homo sapiens
  misc_feature: GYAE6OF01DPQMT.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggacgtggggtgtactgtaacagccctgcgtggcgaggagggaccagggccacccgtcctccgagggacgcccagtcgctgcgaaggtccgggaccaggacggtcgccccgtgaacctggaacgccaagtcgaacgacccgaaagacgacggaccgtaaaggttcgggttagcggaacgaccccgttggacggacgccggtacgggtcccgtcgggtacccgagggcgacggccgcgtccggccccgtggcctcgcgtcggcgtcgggtcgtcggacgtacgtccggtccgccgtacgtcggtccgtcggccgtcggtacccgtaccgtaacgttcggttacgaccgtaacccggacggaaacccgggacccggggaaacccgaaccggacccgttacgggacccgtaccgtacggtacgggttaacggaacggtaccgacggtaccgaccgtccgaccgggtccgtaccgggccggtaaccgggtccggttacgggtaccggggaccggtaccgggtaccggaacccggtaccccggaaacccgtacccccgaaacccgtaccttacccggacccgttacgttccccgttaaccccgg

SEQ ID NO: 18390 - DNA, 841 bp, Homo sapiens
  misc_feature: GYAE6OF01BIOAS.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccagggcaccgtcctccgagggacgcccatgctgacaaggtccgggccaggacggtcgcccctagaaccgtggaacggccaagtgaacgaacccaaagaccgacggaccgaaggttggggttagtggaaccggaccccgtagggacgggtacggccgttacggggcccttacgggtacccgacggcgacggccgcgttccggcccctggcctcggcgttcggcgttcgggtcgtcgggaccgtacggttccgggtccgacccgtacggtccgggtccgttcggtcggttccgacccggtaccccgtaaggtttcgggtaccgacccggaaaccggtaaccggaaaccgggggtaccccgggggaaaccccaaccggggtacccccggtacgggacccgtacccgttacgggtaacgggttacgggtaaaccggcccggaaccgggtcccgtaaccgtcccggacccggacccggttcggggaaccccgggtacgggtcccggttacgggggtacgggggcccgttaaggggtaccccggaaccgggttacccccggaaaccggaccccccgtaaaccccgtcggttacccggtaacccgtcccggtttcccgttaacccccccgg

SEQ ID NO: 18391 - DNA, 649 bp, Homo sapiens
  misc_feature: GYAE6OF01CJ8QA.14.70.G04.1.454.CMB.1.raw
  modified_base (383)..(383): a, c, t, g, unknown or other
  misc_feature (383)..(383): n is a, c, g, or t
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccggtcctccgagggacgcccatgctgcaaggtcgggcagaggtgccctgaacctgaagccaatgagaccaagacaggaccaaggtcgggtgtggacgacccgtgaggagcgtcgggccctggtcccgaggcagcgctcggccctgctgctgcgtggtcngacctagtcggtccgccagtcggcctgtcctcgccgtaccctaagttcggttcgaccgtaccgacgaaacgggccgggaacccacggacccgtgggaccgtccgtacgtaggttacggaagtaccggaacgtccgtacgtacccgaacggtccctacgggccggaccggtccggtgggtacggggccgtagggtaccgacggaaccccgtaaccgggaaccccctaaaccccgaccgttaccgtaccctccgttcccgtaccccgg

SEQ ID NO: 18392 - DNA, 607 bp, Homo sapiens
  misc_feature: GYAE6OF01E2UI6.14.70.G04.1.454.CMB.1.raw
  modified_base (461)..(461): a, c, t, g, unknown or other
  misc_feature (461)..(461): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaaggtcggccagaggtcgcccctgaacctgaaggccaatgagacccaagacaggccaaggtgggttgtgagacccctggaggagcgtgggccctggtcccaggcagcgctcggccctgctgctgctgggtctggccagtcggtcgcccagtcggcctgctcgcgcctaagtgttcgcaccgacgaaacggccgggacccacgacccgtgggacnccgtagacgttcggaacgccgacgtaccgactcccgacgccgtacggccggacgtccgtgggtcggggcctagggtccgaccggaccccgaaccggacccctaaacccccggtacgtaccgtcctaaccgttcccgttacccccgg

SEQ ID NO: 18393 - DNA, 634 bp, Homo sapiens
  misc_feature: GYAE6OF01CMJ7H.14.70.G04.1.454.CMB.1.raw
  modified_base (315)..(315): a, c, t, g, unknown or other
  misc_feature (315)..(315): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggacggtgcccctgaacctgaaggccaatgagacccaagacaggccaagtggtgngacgaccctgaggagcgtgggcctggtcccaggcagcgctcggccctgctgctgcgtggtctcggccagtcggtcgcccgagtcggcctgcgtcgccgtcccgaagtcggtcgccgaccgcgaaacgggcccggggaacccacggaccccgtggacgccgtacgaggttcggaacgccgacggtcccgacgtcccacggccctcgggccggtacggcccggttgggtcgggggaccgtacggggtacccgaacggacccccgaaacgggacccccaaaccccggaccttaccggtaccctaccgttcccgttaccccgg

SEQ ID NO: 18394 - DNA, 689 bp, Homo sapiens
  misc_feature: GYAE6OF01CHL14.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccagtgctgcaagtcgggccagaggtcgccccgtgaaccgtgaaggccaaatgaacgaacccaagaccgaggaccaaggtgggttagtggacgaccccgtggacggagcgtcgggccctcggtcccaggcgacgcgcgtcggcccctgctgcgtgtcgtcgggtccgtcggccgacgttcggtccgcccgtagtccgggtaccgtcgaccgttcggaccgtacccgtaagttcgggttacgccgaaccggtaccgaaaccgggcccggggtaaccccgaccggacccgtacggaccgtccgtaccggtaagggttacggaacgccgaacgtcccggactccgacggtccgtacggcggtacggccggtcggacgggtccgagggtcccgaccgggacccgaaccggacccctaaaccccgacgtaccgtacccgtccgttccgttccccgg

SEQ ID NO: 18395 - DNA, 579 bp, Homo sapiens
  misc_feature: GYAE6OF01CHFCZ.14.70.G04.1.454.CMB.1.raw
  modified_base (523)..(523): a, c, t, g, unknown or other
  misc_feature (523)..(523): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgccctgaacctgaaggccaatgagacccaagacagccaagtgggtgtgagacccgtgaggagctgggcctggtcccaggcagcgctgccctgctgctgctgggtctggccagtggtccgcccagtcggcttgctcgccgcccaatcggttgccaccgcgaaacgggccgggacccacggaccctggacgccgtcgtaggttcgaagcgaacgccgaactccgagccgtggcggacgccgtggtcggggctacgggtcnccggaccccaaacgggccctaaaccccgactccggtaccaccgttccgttaccccg

SEQ ID NO: 18396 - DNA, 658 bp, Homo sapiens
  misc_feature: GYAE6OF01BF7DF.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggacggtcgcccctagaacctggaacggccaatcgaacgaacccaagacgaggaccaaggtgggttgtgacggaccccgtggaggagccggtcgggcccgtcggtcccgacggcgacgccggccgtccggccccgttgccgtcgccgtcggtcgtcgggtcgtcggccgagtccggtccgcccgtagtcggccgtgccgtcgccgtccgtagtcggtcgacgaccgacgaacggcccgggaacccacggacccgtggaccgtcctacggtaggtacggaacgccgacgtccgactccgacgccgacggccggacgtccggtcggcggggcgtaggccgacggtaccccgaacggaccccgaaaccccgtcgtaccgccctcccgtccgttccccccgg

SEQ ID NO: 18397 - DNA, 683 bp, Homo sapiens
  misc_feature: GYAE6OF01BD1O5.14.70.G04.1.454.CMB.1.raw
  modified_base (264)..(264): a, c, t, g, unknown or other
  misc_feature (264)..(264): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtncccctgaacctgaaggccaatgagacccaagacaggccaagtggttgtgagacccctgaggagcgtgggccctggtcccaggcagcgctcggccctgctgctgctgggtctggccagtcggtcgcccgatcggcctgcctcggcgcccaagtcggttcgccgtaccgcgaaacgggccggggaaccccacggaccccgtgggaccgtcccgtaccgtaacgggttcgggaaacggtccgaacggtacccggaacttacccgaacggtccccgtagggacccggggacggtcccggttacgggtcggggggacccgtacgggggttacccgaaccgggtcccccgaaaacccggggtcccccgtaaaaccccccggtccggtacccggtcccgtaaccccgtttccccgttacccccggg

SEQ ID NO: 18398 - DNA, 722 bp, Homo sapiens
  misc_feature: GYAE6OF01BO96Y.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgacaagtcgggccaggaggtcgcccctgacctgaaggccaatgagacccaagacaggccaagtcggttgtgacgaccctggaggacgctcggggccctcgggtcccgagggcacggcgcgtccgggcccctcggctcgctcggcgtcgggtctcggcctagtcggtccgcccagtcggtcctcggtccgtcgccgtcccgtaacgttcgggtccgtcgaacccggacgaaaccgggccgggaacccgacggaaccccggtcggtaacgcccgtccggtaaggttaccgggaacgcgaccggtacccgacttcccgacggcgtaccggaccgggtaccggtccgtcggggtacgggggtccggtacgggttaacccgggcccggaacccccggaaaccccgggacccccgtaaaccccccgggtacccgttaaccccgttaccccggttacccgttccccggttttaaccccccccgg

SEQ ID NO: 18399 - DNA, 654 bp, Homo sapiens
  misc_feature: GYAE6OF01B5RG3.14.70.G04.1.454.CMB.1.raw
  modified_base (186)..(186): a, c, t, g, unknown or other
  misc_feature (186)..(186): n is a, c, g, or t
  modified_base (241)..(241): a, c, t, g, unknown or other
  misc_feature (241)..(241): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagaagccagtccagggagaggacagagccaatggactggggtntactgtaacagccctgctggcgagagggaccagggccaccgtcctccgagggacncccatgctgacaaggtcgggccaggaggtcgcccctgaacctggaaggccaatgacgaccaagacaggccaaggtggtgtcgacgacccctgaggagcgtcgggcctggtcccaggcagcgctcggcctgctgctgcgtcgggtctggccagtcggtccgcccgtagtcgggtcctcggccttcggccgtacctaagtcgggtacgccgaaccgtacgaaacgggccgggaacccacggacccgtggacgtccgtacgtagggttcggaacgccgtagacccgtacgtacccgacggtcccgtgggacccggtacgtccggtacgggtacggggccgtacgggaccggacccggacccggaaaccggccccgtaaaccccgcgtacccgtacctccgttccgttacccccggg

SEQ ID NO: 18400 - DNA, 665 bp, Homo sapiens
  misc_feature: GYAE6OF01ATZSU.14.70.G04.1.454.CMB.1.raw
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggacgtggggtgtactgtaacagccctgctggcgagagggaccagggcaccgtcctccgagggacgcccatgctgcaaggtccggccaggaggtcgcccctagaacctgaacggccaatgacgaccaagacgaggccaaggtgggttgngacgaccctggaggagtcggccggcgtccgacgcgcgcgcgcgcccgccncgcgcgngtcgtgtcggtcgtcggacgtcggtccggccaccgtcggtcgtccgtcgcgtccgccgtacgtacggttcgtccgaccgtaccggaacggacccgggacccggaccgacccggtccgacggccgtcgtacgttacgggacgaacgtcgacgtaccgacgtccgacgtcccgcggaccgtaccggtcgggtacggggcggtaccggtacggaccggtacccgacccggaaccccgaccccctaacccggtactacccgtacccgtccgtttcccccgtacccccg

SEQ ID NO: 18401 - DNA, 684 bp, Homo sapiens
  misc_feature: GYAE6OF01DL0FK.14.70.G04.1.454.CMB.1.raw
  modified_base (665)..(665): a, c, t, g, unknown or other
  misc_feature (665)..(665): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcacccgtcctccagggacgcccaatgctgcaaagtccgggaccaggaggtcgccccgtagaaacctgaacggccaaatgaacgaacccaaagaacgacggaccaaggtggtgtgacgacccgtgaggagcgtcgggccctcggtcccgaggcgacgcgcgtcggccctgctgctgcgtggtctcggccagtcggtcgcccgtagtcggccgtcgtcgtccgccgtacccgtaagttcggttcgaccgtaaccgacgaaaccgggccggggaaaccccgacggaaccccggtcggaacgtcccgtacgtacggttacggacgaccgaacgccgtaactcccgacgtcccgtaggcccggtacgtcccggtcggtacgggggcaagggtccgaaccggtaccccgaaacccgggaccccgtaacccccgtaacgtccggttaacccncccggttcccgttaccccg

SEQ ID NO: 18402 - DNA, 616 bp, Homo sapiens
  misc_feature: GYAE6OF01EQ21U.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccaggaggtcgcccctgaacctgaaggccaatgagacccaagacaggcaagtggttgtgagacccctgaggagcgtgggccctggtcccaggcagcgctcggccctgctgctgctgggtctggcagtcggtccgccagtcggcctcgctcgccgccgtaagtcggttcgccgaccgacgaacgggccggggaccccacggaccccgtggacgtcccgtacgacggttacggaacgtcgacggtacccgacgtccgacgcccgtggccggacgccggtgggtcggggcgtagggtaccaccgggaccccgaaacggcccccgtaaaccccgaccgttacgtccctaccgtccgttaccccg

SEQ ID NO: 18403 - DNA, 643 bp, Homo sapiens
  misc_feature: GYAE6OF01BIG9I.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcggccagaggtcgcccctgaacctgaaggccaatgacgaccaagacaggccaagtgggtgtgacgaccccgtggacggagcgtcgggcccgtcgggtcccaggcagcgcgtcggcccctgctgctggcgtgggtctcggcctagtcggtcgcccagtcggccgtgccgtcgccgtacccgtaagtcggttcgaccgtaccggacgaaacgggccgggaacccacggaccccgtacggacgccctacgaggttacggaacgtaccgacgcccgacgtcccgacgccgtcggcggacgtcccggtgggtcgggcgtacgggtacgaccggacccgtaaccggacccccgtaaccccgtaccgtaccgtaccgtaccgtcccgttacccccgg

SEQ ID NO: 18404 - DNA, 614 bp, Homo sapiens
  misc_feature: GYAE6OF01D50ZU.14.70.G04.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggacncccatgctgcaagtcggcagaggtcgcccctgaacctgaagccaatgagacccaagacaggccaaggtggttgngacgacccgtggaggaggctgggccctgggtcccaggcncgcgctcggccctgctgctgctgggtctggccagtcggtccgcccgagtcggcctgcctcggcccgtcccgagttcggtcgaccaccggacgaaacgggccgggaaccccacggacccgtggaccgtccgtacgtaggttacgggaagtcgaacggtcccgaactccgacgcccgtggccgggacgccggtgggtcggggacgtaggtccgaccgaccccgaacggaccccaaccccgtactcgtaccctacgtccgttccccg

SEQ ID NO: 18405 - DNA, 669 bp, Homo sapiens
  misc_feature: GYAE6OF01EF97F.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaacggccaaagtgaacgaacccaagaacaggaccaaggtgggttgtgacgaccccgtggagggagcgtcgggccctggtcccgaggcagcgctcggccctgctgctgcgtgggtctggccgtagtcggtcgcccgagtcggcctgctcgccgacccaaggtcggtcgacgtaccggacgaaccgggccggggaacccacggacccgtggacgtaccgtcgaacggttacggaacgccgaacggtcccgaacgtcccgacggacccgtggaccgggcggtacccggtcgggtcgggggccgtagggtcccggtaaccgggaccccggaaaccggacccccgaaaccccgtaccgttaccggtacccgtacccgttcccggttaccccccggg

SEQ ID NO: 18406 - DNA, 613 bp, Homo sapiens
  misc_feature: GYAE6OF01D8J50.14.70.G04.1.454.CMB.1.raw
  modified_base (317)..(317): a, c, t, g, unknown or other
  misc_feature (317)..(317): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaaggtcgggccagaggtcgcccctgaacctgaaggccaatgagacccaagacaggccaagtgggttgngacgacccctggaggagcgtcgggccctcggtcccaggcagcgcgtcggcccgtgctgctgcgtggtctcggcagtcggtcgccagtcggcctgcctcggccgtcccaagttcggttcgaccgaccgacgaacggccgggacccacggacccgtggacgcctcgaggttacggaacgacgacgccgtactccgacgccgtggccggagccggtgggtcggggcgtagggtcgacggaccccgaaaccggaccccgtaaaccccgacgttaccgtccctaccgtcccgttaccccgg

SEQ ID NO: 18407 - DNA, 588 bp, Homo sapiens
  misc_feature: GYAE6OF01DYW4U.14.70.G04.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
  modified_base (270)..(270): a, c, t, g, unknown or other
  misc_feature (270)..(270): n is a, c, g, or t
  modified_base (424)..(424): a, c, t, g, unknown or other
  misc_feature (424)..(424): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
  modified_base (578)..(578): a, c, t, g, unknown or other
  misc_feature (578)..(578): n is a, c, g, or t
tcagcgtctagtaccacgaccggtgctcgatttagtgtagtgtgaagggaaaggggagggcagttggtagatgcccctctgggagagatccccagggggtgacagccatggaccctgggaagggcctgggctagggacagggaccagagcccagtccgagggagaggacagagccaatggactggggtntactgtaacngcctgctggcgagagggaccagggccaccgtcctccgagggancccatgctgcaaggtcggcaggaggtcnccccgtagaacctggaaacggccaaagtcggaacgaacccaaggacgacggacctaaggttcgggtttgtacggaaccgacccgttaggaggtacgcgtcggggaccctgggtacccaggcacgccgcctcggccctgcctgctgccgtggtcnggacctagtcggtccgccgagtcggcctgctcgccgacctagtcggtcgacgacgacgaacggccggacccagccgtggactcctgagtcgagcacgcanccgngcgcgcggacncgtggcggcgagacgccgaccgagaccctactcacgtcncgtcgtcccg

SEQ ID NO: 18408 - DNA, 645 bp, Homo sapiens
  misc_feature: GYAE6OF01BX67F.14.70.G04.1.454.CMB.1.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
  modified_base (488)..(488): a, c, t, g, unknown or other
  misc_feature (488)..(488): n is a, c, g, or t
  modified_base (563)..(563): a, c, t, g, unknown or other
  misc_feature (563)..(563): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatcgctgcaagtcggcaggaggtgcccctgacctgaagtccaatganacccaagacaggccaggtgggttgtgacgacccctggacggagcgtcgggacccgtcggtacccgaggacacggccgcgtcggcccctgccgtgctggcgtgggtctcggacngtcggtccgccctagtcggcctgtccgtcgccgtccaagttcggttcgcgaaccggacgaacgggcccgggaaccaccggtacccgnggacgccgtacgaggttacgggaacgcgtacggcccgacgtccgacgcccgtggccggtaccggtccggtcgggnggggtccgacggttcgaccggacccgaaccggaccccaacccccgtacttacccggtaccctaccgtcccgtttacccccgg

SEQ ID NO: 18409 - DNA, 636 bp, Homo sapiens
  misc_feature: GYAE6OF01D3AU2.14.70.G04.1.454.CMB.1.raw
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
  modified_base (535)..(535): a, c, t, g, unknown or other
  misc_feature (535)..(535): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtccgggcagaggtgccctgaacctgaaggccaatgagaccaagacaggccaagtggttntgacgccctggaggacgcgtcgggccctgggtccccaggcagcgctcggcccctgctgctgctgggtctggcngtcggtcgcccgatcggcctgtctcggccgccgtaagtcgggttacgaccgaccggccgaaacgggtccgggaacccctacggacccttgggacgtccgtcgaggttacgggacgtacgacggccgtatcccgaggtcctaggccggggacncccggtgggtcggggaccgacgggtaccaacgggacccccgtaaagggaccccccgtaaaccccgaccgtacgttacccgacccgtttccgttacccccgg

SEQ ID NO: 18410 - DNA, 737 bp, Homo sapiens
  misc_feature: GYAE6OF01CFGZY.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggacggtcgcccctagaacctggaacggccaatgaacgaacccaagacaggccaaagtgggttgtgagaccccgtggacggacgcgtcgggccctcggtacccgaggcacggcgcctcggtcccctgccgtcggtcctcggcgttcgggtccgttacggcccgtagttcggtccgccccgtagtccgggccctcggtccgtccggtacccgtaccccgtaagttcggttaccgccgtaacccggaaccggaaaccgggccggggaaccccgaccgggtaaccccgtacgggaaccgtcccgttaacggtacggttaacggtaacgggaccgtacgggtacccgacgttacccgaacggtcccgacgggacggtaccgacggtcggggtcggggtaccgagggttacccgaaccgggtaccccgaaccgggtaccccaaaccccgtactcccgtacctcccgtccgttaaccccccgg

SEQ ID NO: 18411 - DNA, 719 bp, Homo sapiens
  misc_feature: GYAE6OF01C8QB6.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctaggggacagggaccagagccagtccagggagaggacagagccaatggactggggtgtactgtaacagccctgctggcgagagggaccagggcaccgtcctccgagggagcccatgcctgcaagtcgggccaggaggtcgcccctgaaccctgaacggccaagtgaacgacccaagacacggacctaaggtgggttgtaggacgtaccccgtggacggacggcgtcggggcccgtcggtaccccagggcgacggccgccgtcggccccgtgccgtgcctggtcgtgggtcgtggacccgtgttccggtccgcccgtagtccgggccttacgccgtacggcccgtacccctaagggttcggtttaccggacccgtaacccggaacggaaaccgggcccggggaaaccccgacggaaccccgttgggacccggtctaccgggtaagttcgggaacgtaccgacggtccgacgtacgaccggtcctgggaccggccggtaccggtcgggtacggggtcgacggggttccaccggtacccggaaccggaccccctaacccgtacgaccgttacccctcgttcccgttaccccgg

SEQ ID NO: 18412 - DNA, 648 bp, Homo sapiens
  misc_feature: GYAE6OF01CGG9D.14.70.G04.1.454.CMB.1.raw
  modified_base (185)..(185): a, c, t, g, unknown or other
  misc_feature (185)..(185): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcagtcgtcctccgagggacgcccatgctgcaagtcggccagaggtcgccctgaacctgaacggccaatcgagaccaagacacggccaagtgggttgngacgaccctggacggngcgtcggcccgtggtcccgaggcngcgcncggccctgctgctgcgtggctcggcngtcgtccgccgcgtcgccgtgccgtcgccgacccgtagtcggttccgaccgaccggacgaaacgggccgggaacccacggacccgtcggaccgtcccgtacggacgttacgggaacgaccgggacgtaccgactacccggacgacccgtcgggaccggacggtcccgtcgggtccgggtacggtacgggtcccgacccggaccccgaacgggtacccccaaaccccgtccggttaacccgtacctcccgtttacccccgg

SEQ ID NO: 18413 - DNA, 736 bp, Homo sapiens
  misc_feature: GYAE6OF01BM8I6.14.70.G04.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccagggagaggacagagccaatggactggggtntactgtaaacngccctgctggcgagagggaccagggcaccgtcctccgagggacgcccagtgcctagcaaggtccgggccaggacggtcgccccggtacacgtaacggaccgactaggacgaacccgaacgaacgacggaccgaaggtaggggttggtacgaacggaacccccggttggaaggggacggtccggtcgggccccggtcggtacccggacggacgcgccggccgtcggccccgtccgngtcgtcgngtcgtagggtcgtacggcgtacgtcggtcgacccgngtcggccgtacgtcggacgtccgcctaagttcggtcgacgaccgacgaaacggcccggggtacccaccggaccgtaccggcgtacccggttcgaagttcgggaagaccgtccgaccgttaccggccgtaccgcggttacgcgggcgtacccggtggtcggggaccgagggttcccgaaaggtccccccgaaagggtaccccccgaaccccctaaacgggttcccttaaccccggctttccccgttaccgttacccccccccg

SEQ ID NO: 18414 - DNA, 724 bp, Homo sapiens
  misc_feature: GYAE6OF01DJMUM.14.70.G04.1.454.CMB.1.raw
  modified_base (707)..(707): a, c, t, g, unknown or other
  misc_feature (707)..(707): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccgagggagaggacagagccaatggactggggtgtactgtaacagccctgctggcgaggagggaccagggccaccgtcctccgagggacgcccatgctgacaaggtcggccaggaggtcgcccctagaacctggaaacggccaagtcgaacgaacccaagacaggaccaaggtgggttgtagacgacccgtggaggacgcgtcgggcccttgggaccccaggactacggccgccgtcgggcccctgccgtcgacgtcggccggttgggtaccgtcggtacccgtaggttccggggtacccgacccgtaggttcgggcccgttcggtccgtaccggacccgtacccgtaaaggttcggttaccgacccgaaccggaccggaaaccgggccgggaaccccgacggaccccgtgggacgtcccgtacggtaggttaacgggaacgtaccggacgccgtactcccgacgccggtcggaccggtacggccgtgggtcgggacgtacggtccgaaccggtacccgaaaccggcccctaaaccccgtacgtaccgttaccnccgttcccgttaccccg

SEQ ID NO: 18415 - DNA, 671 bp, Homo sapiens
  misc_feature: GYAE6OF01C8DCM.14.70.G04.1.454.CMB.1.raw
  modified_base (375)..(375): a, c, t, g, unknown or other
  misc_feature (375)..(375): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcaggagcccatgctgcaagtcgggccagacggtgccccctagaacctgaacgccaatgagacccaagacaggaccaaggtgggttgtaggacgaccctaggacggagcttcgggcctggtccccaggcagcgctggccctgctgcngctggtctggctatggtcgcccagtgcctgcgtcgcgccctaagtggttcgcaaccgtacgaaacggtcccgggaacccaagggtacccctagggaccgtcccgtacgtacggttacggaacgccgaacggtaccgaacgtcccgaacgtcccggttacggacccgggtaacggcccggttaggtaccgggggggtccgtaaggggttcccaaacgggacccccaaaacccggggtacccctaaaaccccccggtacgtaccgtttaccccgtaaccgttccggtttaaccccccg

SEQ ID NO: 18416 - DNA, 810 bp, Homo sapiens
  misc_feature: GYAE6OF01D9NHK.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagcagtccagggagaggacagagccaagtggacgtgggggtgtactggtaacacgccctgcgtggcgaggacgggaccgagggccaccggtcctccgagggacgcccatcgctgacgaggtcgggccaggacggtcgcccctaggaacctacggaacggaccaagcggaacgaacccaaggaccgaggaccgtaaggtcgggtttcgacggaccgtaccccgtaggacggacgtcggtcgggcccgtacgggtcccgacgggccacgggtcgccccggtcggccccgttcggccgtcggtcgtacggtccggtacggttccggtccggccgttacggtcccggtcgccgtaacgggtccgtccgtcgccgtccgtccgaccgtaggtcggtcgacctaccgggtaacgaaccgggaccggaacccgaccggtaccgtacgggacgttacccgtacgggtacgttaacgggacccgtaccgaccgggttaacccgaccttaccgaacccgggtcccggtaacgggccgggttacccggtaccgggtacggggttaccggggaccgttacccgggaacccgaacccgggttaaccccgaaaccccggaccccgtaaacccccgtaccggttaccccgaccggttacccgttcccgttaaccccccgg

SEQ ID NO: 18417 - DNA, 693 bp, Homo sapiens
  misc_feature: GYAE6OF01CHS3N.14.70.G04.1.454.CMB.1.raw
  modified_base (550)..(550): a, c, t, g, unknown or other
  misc_feature (550)..(550): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagacgggaccgagggccaccgtcctccgaggggacgcccatcgctgacaaggtcgggccaggacggtcgccccgtgaaccctggaacggcccaatcgaacgaaccccaaagaccaggacccgaaaggtgggttagtggacgaccccctggacggagccgtcggggcccctcgggtccccagggcgaggccgccgtcggcccctgccgtgcgtcggcgtgggtctcggccgtagtcggtccgcccgtagtccggtccgtcgtccgtccggccgaccccgtaagttcgggttcgacccgtaacccggaccgaaaccgggcccggggaacccaccggtaccccgngggaccgtccgtacgtacggttacggaacgcgacggtacccgancccgngccgtgccggcgtccggtggcggggccgagggtacccgcggacccgaacccggaccccgaacccgtaccgtacgccctccgttcccgtccccgg

SEQ ID NO: 18418 - DNA, 698 bp, Homo sapiens
  misc_feature: GYAE6OF01A2V2L.14.70.G04.1.454.CMB.1.raw
  modified_base (675)..(675): a, c, t, g, unknown or other
  misc_feature (675)..(675): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaacggtccgggccaggacggtcgccccctgaaccctgaacggccaatgagacccaagacaggccaagtgggtgtgagacccctggaggagcgtcgggcccgtggtccccgaggcaggccgcgtcggcccctgctgctggctgggtctcggcctagtcggtccgcccgtagtcggccgtcgctcggccgcccctaagttcggttacgccgacccgaccgaaacgggcccggggaacccacggacccgtcggaccgtccgtaccgtacggttacggaacgtccgaacggcccggtaacttcccgacggacccgttcgggccgggtacggtcccgggtgggtaccgggggtaccgtacggggtaacccggaccgggaaccccccgaaacgggtacccccctaaacccccggacctacccggttaccccnccgtttcccgtttaccccccggg

SEQ ID NO: 18419 - DNA, 611 bp, Homo sapiens
  misc_feature: GYAE6OF01BEZHU.14.70.G04.1.454.CMB.1.raw
  modified_base (185)..(185): a, c, t, g, unknown or other
  misc_feature (185)..(185): n is a, c, g, or t
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggagcccatgctgcaagtcggcagaggtnccctgaacctgaagccaatgagacccaagacaggccaagtgggttgngacgacccctgacggagctgggccctggtcccaggcaggcgctggccctggctgctgctggtcnggccagtgccgccagtcggctcgcgtcgccgccaagtcggttgcctaccggcgtaaacgccggggaacccacgggacccctagggtaccgccgttccgaacgggtttcggaaacgtcgacgtcccgattcccgaagcccgtggccgtacgcccgttgggacgggggctacgggtccgtaccgggaccccgaaagggccccaaaccccgaccgttagtacccaccttcggttacccccg

SEQ ID NO: 18420 - DNA, 812 bp, Homo sapiens
  misc_feature: GYAE6OF01A86KA.14.70.G04.1.454.CMB.1.raw
tcagcgtctagtaccacgaccggtgctcgatttagtgtagtgtgaagggaaagggggagagaggagcccagccctgggattttcaggtgttttcatttggtgatcaggactgaacagagagaactcaccatggagtttgggctgaactggcttcttcttgtggctattgtaaaaggtgtccagtgtgaggtgcaactgttggagtcgtgggggaggtcgttggtacagccgtcggggggtaccctaaaactctcctgtaccaacctcaggtattcgtcctttcgcatctatcgccagtcggccgttcgggtcccgccagtacgttccgaagggggaacggggcgtagggagtggactcctacaacttagttaggtagggtaaggttggggaggttggtagaactccaactactaacgttacgacgacggtccgttcgtggtacgggtaacggggtcccgtttacgaaccctacttcccgtaccgaaggtaaccgaaacctaacctttaaccccgaaaactaaacccctaaccgtttaacctttttaacgtaccgttaacgtaaacctaaaagttaccggaaaacccgcgtaccccgtaggacccgggtaacggacccgggaaacgggaaccccgaacccgggtacccctttaaagtttaacgttacccgtaggtacgaaccgtaaaggacgtaaaccggtaccggaaaaccggtccgggggaccccgggttaggggaaccccgttaccccggtttaggaacccggttaccggggtaccggggaaccccggtaacggggtaaaccccctaggg

SEQ ID NO: 18421 - DNA, 694 bp, Homo sapiens
  misc_feature: GYAE6OF01BPPI7.14.70.G04.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacncccatgctgcaagtcggccagacggtncccctgaacctgaaggccaatgagacccaagacaggaccaagtggttgtgagacccctggaggagcgtgggccctaggtcccgaggcagcgctggccctgctgctgcgtggctggcctagtcgggtccgcccgacgtacggcccgtggcccgttcggcccggtaccccgtaagttcgggttcggtccgaaccggtacgtaaacgggccggggaaccccgacggaaccccgtcggggacgccgttccggtaacgttcgggaacgccgacgtaccggactcccgtacgcccggttacgacccgggacgtccggtacggtccgggggtacctaggggttccgaacgggaacccccggtaacccgggaaccccgtaaaccccccgtaccgttaccgggttcccctaaccggttcccgtttaaccccccgggg

SEQ ID NO: 18422 - DNA, 880 bp, Homo sapiens
  misc_feature: GYAE6OF01CVVB9.14.70.G04.1.454.CMB.1.raw
  modified_base (238)..(238): a, c, t, g, unknown or other
  misc_feature (238)..(238): n is a, c, g, or t
  modified_base (339)..(339): a, c, t, g, unknown or other
  misc_feature (339)..(339): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggccaccgtcctccagggacncccatgctgcaaggtcggccaggacggtcgcccctagaacctggaacggccaagtgaacgaccaagacacggccaaggtgggttgtgacgacccgtgaggngcgtcgggccctggtcccgaggcgagccgctcggccctgctgtctgcgtgcgtcgtcgcgtagtccggtccgccgtacggtcggtccgtcggtccgtaccggtacccggtacccgttaaaggttcgggttacccggtaacccggtaaccccgggtaaccgggtaaaaccccggggacccccgggggggtaaacccccgtaaccccgggggttaacccccggggttaaccggggtaacccgggttaacccccgggtttaccgggttaaacggggtttaaccggggaaccgggtaaccccgggtaacccggtaaccccgggttaaccggttacccccggaccgggttacccccggtccgggggttaaccccggggtaccgggttacccgggttaccgggggtaccggggggtaaccgggtttaacccgggggtaccccggtaaaccccggggtaaccccccggtaaaccccgggtacccccccgtaaaaccccgtaccccggtttaccccgtaccccgttacccccggttttaccccccgggg

SEQ ID NO: 18423 - DNA, 792 bp, Homo sapiens
  misc_feature: GYAE6OF01BTFMO.14.70.G04.1.454.CMB.1.raw
  modified_base (187)..(187): a, c, t, g, unknown or other
  misc_feature (187)..(187): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagaccaatggactggggtntactgtaacagccctgctggcgagagggaccagggcaccgtcctcgagggacgcctagtgctgacaaggtcgggaccaggacggtcgaccccgtaggaaccgtggaacggaccaagtacggaacgaaacccgaagaccgaacggaccggtaaggttggggttagtacggacggtaaccccgtaggaacgggacgtacggtcggggtacccgtttcgggacccggagggccgacggccgtccggttccggccccttggccgttcgcggtcggtcggttcgggtaccgtcggccgtacgtcggtccccgaccgtacggtcggccgttcgaccgtcggcccggtacctaaggttcgtacggccgtaaccggacggaaccgggaccggggacccaccggtacccggtacggaccggtacctacggtaacgggtacggaaacgccgacggtacccggacgttacccggacgtacccggcgggttaccgggaccgtccggttacggggaccggggtcgtaacccggggtacgaccccggaacccggtaaaccggaccccccgtaaccgaccgttaccgtaacccgttaccccgttcccgtttaacccccgg

SEQ ID NO: 18424 - DNA, 638 bp, Homo sapiens
  misc_feature: GYAE6OF01EYJW4.14.70.G04.1.454.CMB.1.raw
  modified_base (537)..(537): a, c, t, g, unknown or other
  misc_feature (537)..(537): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcggccaggaggtcgcccctgaacctgaacgccaatgagacccaagacaggccaagtggttgtgacgacccctggaggagcgtcgggccctcggtcccagggcagcgcgtcggtcctgctgctgcgtgggtctcggcagtcggtcgcccgtagtcggtccgtgccgtcggccgtaccgtaagttcggtacgaccgaccgacgaacgggcccgggaacccgacggacccgtggaccgtcccgtacgtacggttcggaacgccgacggtccgtactccgacgtccgngggccggacgtccggtgggtcggggcgtagggtaccgaccggacccggaaccggaccccgtaaccccgtaccgtacgtaccctacccgtccgttacccccg

SEQ ID NO: 18425 - DNA, 744 bp, Homo sapiens
  misc_feature: GYAE6OF01DZMSQ.14.70.G04.1.454.CMB.1.raw
  modified_base (241)..(241): a, c, t, g, unknown or other
  misc_feature (241)..(241): n is a, c, g, or t
  modified_base (387)..(387): a, c, t, g, unknown or other
  misc_feature (387)..(387): n is a, c, g, or t
  modified_base (548)..(548): a, c, t, g, unknown or other
  misc_feature (548)..(548): n is a, c, g, or t
tcagcgtctagtaccacgaccggtgctcgatttagtgtagtgtgaagggaaaggggagggcagttggtaggtgcccctctgggagagatccccaggggtgacagccatggaccctggaagggcctgggctagggacagggaccagagccagtccaggggagaggacagagccaatggactggggtgtactgtaacacgcctgctggcgagagggaccaagggcacccgtctccgagggganccccgatcgcgtgacaaggtccggggacctaaggacggttcgccccctaggaacctaggaacggaaccgaagtagaaccggaacccaaaacggaaccgaacgggtacccgtaaggtaggggttacgttcggtaacggtacccccgngggtaacgggacgttccggcgggtccccgttcgggtaccccgagggccaaggcctcggtaccggcccctgccgttgcgtcggcgtggggtaccgttcgacctaggtccgggtcgcccctagtccggccgttacgcgtcgtcccgaccctaagtcgggttcncgaacctaggaacccggcggggaacccacggacccgtggaccgtcgttaccgaggttaggaaccgtcgaacgccgtgtacccgacgcgtacgcggtacgccggtgggtaccgggacgtacgggtccgacgaaccccggtaacgaccccgaccccgtacgtaccggttcctacccggttcttcccggttaccccccg

SEQ ID NO: 18426 - DNA, 623 bp, Homo sapiens
  misc_feature: GYAE6OF01AQYIV.14.70.G04.1.454.CMB.1.raw
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaaggtccgggccaggacggtcgcccccgttagaacccgtggaacggccaaatcgaacgaacccaaagacgaggcccaaaggtgggttagtggacgacccctggaggagcgtcgggccctggtcccgaggcagcgctcggccctgctgctgcgtggtctggccagtcggtcgccgagtcggcctgcgtcgcgccgtagtcgtcgccaccgacgaacggccgggacccacggacccgnggcnccgtcgacggtcgaacgtcgacgaccgactaccgcgtaccgtcggcggacgtccggtagggtcgggcgacgggtccgacggaccccgaaccggaccccaaccccgcttacggtccctaccgtccgttacccccg

SEQ ID NO: 18427 - DNA, 634 bp, Homo sapiens
  misc_feature: GYAE6OF01A7828.14.70.G04.1.454.CMB.1.raw
  modified_base (488)..(488): a, c, t, g, unknown or other
  misc_feature (488)..(488): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcgaaggtcgggccagacggtcgccccgttgaaccgtggaacggtccaatcggacgaacccaagaccaggaccgaaggtcgggttgtcgacgtaccccgtggacggacgcgtcgggccctcggtcccaggcacggcgcgtcggcccctgctgctgcgtggctggctagtcgccgaccgtgtcggcctgctcggccgaccgtagtcggtcgccgaccgacgaacggccggaccacgacccgnggacgtcctacgacggtacgaagtccgacgtccgactccgacgccgtcggcggaccgtccggtagggaccgggtcgagggtccgaaccggaccccgaacggacccccgtaaacccgtcgtaccgtacctcccgttcccgttccccg

SEQ ID NO: 18428 - DNA, 670 bp, Homo sapiens
  misc_feature: GYAE6OF01ENN2F.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtcgccctgaacctgaaggccaatgacgacccaagacacggccaagtgggttgtgacgacccgtggacggagcgtcgggcccgtcggtcccgaggcgacggccgcgtccggcccctgctcgcgtcggcgtcgggtctcggcctagtcggtccgccctagtcggcctcggccgtcgccgaccgtaagttcggtacgccgaaccggaccggtaaacgggcccggggaaccccgacggaccccggtacgggaccgtccgtacgtaacggttcggaacgaccgacggtaccgtacgtccgacggtccgacggccggtacgtccggtagggccggggacctagggtacccaaccggaccccggaaaccggacccctaaaccccgacgtacccgtactccgttccgttacccg

SEQ ID NO: 18429 - DNA, 763 bp, Homo sapiens
  misc_feature: GYAE6OF01CZ09J.14.70.G04.1.454.CMB.1.raw
tcagcgtctagtaccacgaccggtgctcgatttagtgtagtgtgaagggaaaggggagggcagttggtagatgcccctctgggagagatccccgaggggtgacagccatggaccctggaacgggcctgggctagggacagggaccagagccagtccgagggagaggacagagaccaagtggacgtggggtgtactgtaacagccctgctggcgaggagggaccaggaccaccgtcctccgaagggacgcccatgctgacgaaggtccgggaccaggacggtcgacccccgtagaacccgtggaacggaccaagtacgaacgaacccgaagacgacggaccgtaaggtgggtgtacgaccgacccgtggacggcgcggtacggcccgtacggcccaggccgacggccgcggtccgtccctgtcgtcgtcgtcggtccggttcggtccgtcggtaccgtcggttccgggtcccgtacccgtacgggtccgtcccgtcgtccgccggccgtaccgtacgttcggtaccgaccggaccgaaccggaaccgggtcccggggaacccctaccggtacccgtcgggaccgtacccgtagtacggttaccggacaccggacgtacccgcgtaccgaccggtccggcggtaccggcggtcccggtggggacccgggacggtaaccggtacccggaacccggtacccccgaaacccggacccccgtaaaccgtacccggttaccgtcccccttacgtcccccgtttaccccgg

SEQ ID NO: 18430 - DNA, 762 bp, Homo sapiens
  misc_feature: GYAE6OF01BVUCN.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggacgcccatcgctgacaaggtccgggccaggacggtcgccccctaggaaaccctggaacggaccaagtcggaacgaaccccaaaggaccaggaccaaggtgggttgagacgaccccgtggaacggacgcgtcgggcccgtcggtccccgagggccacggcgccgtcggccctgcctgctgcgtgggtcctcggcctacgtcgggtcccgcccgtacgtccgggtcctcggtaccgtccggccgtacccgtaaggtcggtttaccgaccgtaacccggtaacggaaaccgggccggggaaccccgaaccggtaccccgtcgggaaccggtcccgtccgaagggtttacggaacggtaccgaccggcccgtaacctccgaccggtcccgtacggccgggtaccggcccgggttacgggtcgggggtacccgtaccgggttaccggaacccgggaacccccgaaaccgggtaacccccctaacccccgttacgtaccccggttaaccctacccggttccggttacccccgg

SEQ ID NO: 18431 - DNA, 861 bp, Homo sapiens
  misc_feature: GYAE6OF01A9XYA.14.70.G04.1.454.CMB.1.raw
  modified_base (191)..(191): a, c, t, g, unknown or other
  misc_feature (191)..(191): n is a, c, g, or t
tcagcgtctagtaccacgaccggtgctcgatttagtgtagtgtgaagggaaaggggagggcagttggtagatgcccctctggggagagatccccgaggggtgacagccatggaccctgggaagggcctgggctagggacagggaccagagccagtccagggagaggacagagaccaagtggacgtggggtntacgtgtaacagccctgctggcgaggagggaccaggggcaccgtcctaccgagggacgccgatcgctggacaacggtccgggaccaggtacgggtcgaccccgtaggaaacccgtagaaacggaccgtaaagtacgaaccggaacccgaaaacggaaccgaaacgggacccggtaaaggttggggttacggttaccggaacgtaacccccggtaggacgggtacggaccggtcggggtccccgtacgggtacccgacggtaccgacggtaccggtccgtaccgggccccgttcggccgtcggtccgtcgtcggtcggtcgtcggcgtacggtcggtacccgtcgtcgtcggtcgtacggtcgttccgaccgtaccgtaacgttcggtaccgtaaccggacccgtaacgggtaacccggacccgggggaacccgtaaccgtacccggtacgggacccggtaccggttacggtaacggtacgggtaaccggtaccggaacccggtaccggaccgttacccggaaccgttacccgggccggtaaccggtccgggcggtaccgggggtaaccgggccgttaaccgggacggaaccccggaccccgggtaacccggaacccccgtaacccccgtacgttacccggtacctaacccggtcccgtttaccccccggg

SEQ ID NO: 18432 - DNA, 629 bp, Homo sapiens
  misc_feature: GYAE6OF01CF67Z.14.70.G04.1.454.CMB.1.raw
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggactggggtgtactgtaacagccctgctggcgagagggaccagggcaccgtcctccagggacgcccatgctgcaagtcgggccagacggtcgccccgtagacctgaacggccaagtgacgaacccaagacaacggaccgaagtgggtgtgacgacccgtggaggagcgtcgggccctggtcccaggcagccgcgtcgccctgccgtgctcggcgtgggtcncggcgtagtcggtccncccgacgtcggtcctgccgtcggccacccgtagtcgttcgcgaccgacgacgggccggaccngtacccgnggcgcctgtagtcggaacacgngccgagtccgacgtccgtaggccggaccgtccgtagggcgggacgtacggtaccgaccgggacccgaaacccgcccccgtaaaaccccgtacgttcccgaccttcccgttcccgttacccccgg

SEQ ID NO: 18433 - DNA, 658 bp, Homo sapiens
  misc_feature: GYAE6OF01BGW9J.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccgagggccaccgtcctccgaggggacgcccatgctgacaaggtcgggccaggaggtcgcccctagaaccctgaacggccaaatgaacgaacccaaagaccgaggaccgaaggtgggttgtaggacgaccccgtggaggaggcgtcgggccctcggtccccgaggcagccggctcggcccctgctcgctggctcgggtctcggccagtcggtccgcccgtgtcggcctgcctcgccgtacctagtcggttcgcgaccggaccgaacgggccgggacccacggaccccgtggacgccgttacgtacggtacggaacgcaacggcccgaagtcccgacggtccgacgggccggtcgtccggtaggggtcgggacgtacgggtcgaaccggaaccccaaccggacccccaaacccgtacccgtacgtcctacccgtccgttcccccg

SEQ ID NO: 18434 - DNA, 920 bp, Homo sapiens
  misc_feature: GYAE6OF01BTAB2.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagaccaatagacgtgggtatactagtaacagccctgcgtggacgaggacggaccgagggccacccgtcctacgagggacgcccagtcgcgtgacgtaacggtccgggaccgtaggtacggtccgaccccgttacgaacccgtacggaaccggtaccaacgtacggaaccgaacccgaaacggaaccgaacggaaccgtaagggttggggttacgtacggtaaccggtacccccggtagggaacgggaccggtaccgggtccgggtcccggttaccgggtaccccgacgggaccgtaaccgggccgtaccggtcccggccccgttggccgtcggcgtcggtcggttcgggtccgtcgggcgttacgggtccggttcccgaccgtacggtccggtccgttcggtcccggttacgtccggtacccccgttaaggtttcggtaccggtacccgtaacccgggaaaccgggtaaacccggggtaccccgggaaacccccgtaccgggtaacccccggtacgggtaccccgttacccggtaaccgggttacgggttaacgggaaccccgttacgggacccggttaaccccggtaacgtacccggaccggtacccggtaccggggtaccggtaccgggtaccgggtccggggttaacggggaccggtaacccggtaccggtacccggtaaccccggaaaccggtaccccccgtaacccgtaccgtttaccgacccgttcccgtacccggttccccccgg

SEQ ID NO: 18435 - DNA, 1092 bp, Homo sapiens
  misc_feature: GYAE6OF01DPDMH.14.70.G04.1.454.CMB.1.raw
tcagcgtctagtaccacgaccggtgctcgatttagtgtagtgtgaagggaaagggagggcagttggtagatgcccctctgggagagatccccgagggtgacagccatggaccctggaaggcctgggctagggacagggaccagagccagtccgagggagaggacagacgaccaagtcggaacgtggggtgtacgtagtaacacgccctgcgtggacgaggacgggaccgacgggccgacccgttccgaccggacgggacgaccccagttcgaccgtgaccgtaacgggtccgggaccgaggtacgggttccgaccccccgttaaggtaacccgtaggaaaccggaccgtaaaacgttacggaaaccggaaaccccgaaacgggtaaaccgaaccgggtaaccccggtaaaggggtttaccgggggttttacggtaaccggggttaaaccccggtaacccccggtttagggaaaccggggtaaccgggtcccgggttacccgggggtcccccggtttacccggggtaaccccgggacccgggtaccggaacccggggtaccccggtaccggttaccccggggtcccccgtacggtcccggtttccgggtcccggttaccgggttcccgggttttaccggggtcccgttacgggtaccccggtttaacggttaccccggggtccccggtaccccggtaaggttccccgggtcccgtttacggtccccggtaccggtaccccggtaacccgttaacggtttacccggggttaccgaccccgggtaaaccccgaaaacggggaacccggggtaacccccggggtaaccccgtaacccggggtaaccccggtcccggggaaacccgttcgggtaaccgtttaacggggttaacgggaaccgtcccggaaccgggacccgttaaccggacccgtaaccggttacccggacccggtaccggggtacgtacccgggttgggaaccccggggtcgggtaaccggttaccccggaaacccggacccggtaaacccccggtaccccgtaaccccggttaccgtaccggttaacccgtcccgttacccgggtttacccccccgg

SEQ ID NO: 18436 - DNA, 760 bp, Homo sapiens
  misc_feature: GYAE6OF01DG3YL.14.70.G04.1.454.CMB.1.raw
  modified_base (518)..(518): a, c, t, g, unknown or other
  misc_feature (518)..(518): n is a, c, g, or t
tcagcgtctagtaccacgaccggtgctcgatttagtgtagtgtgaagggaaagggggagagaggagcccagccctgggattttcaggtgttttcatttggtgatcaggactgaacagagagaactcaccatggagtttgggctgaactggcttcttcttgtggctattgtaaaaggtgtccagtgtgaggtgcaactgttggagtcgtgggggaggcgttggtacagccgtggggggtacccctaaaacgtcctcctgtaaccaacctcgaggacttcgcctttcgcatctatgccatcggcctgggtcccgccagtacttccgaggggaaggggcgtggaggtggactctacaacttattaggtaggtaaggtgggagtggtagaatccactattattacgcgaggtctcgtggtacggaacggggtcccggttaccaacccgtactaccttcccgaaggaacgaaccttaaactttaccccgaaaacgtaaacggtaacccttaaactttttaacnccgttagaacctaaaacgttacggaaacctacggaccccgttacggaccggtacggaacccgggaaggaacccgtacccgggtacccccttaattaacgtttaccgttaggtacgtaacaaaggtacgtaacgtaccggaaaccgtacggggtaccccggtaggggacccggttcccccggtttaaggacccgtttaccgggaccgggggtaaccccgaaacggggttaacccccgttacgg

SEQ ID NO: 18437 - DNA, 762 bp, Homo sapiens
  misc_feature: GYAE6OF01EWH3V.14.70.G04.1.454.CMB.1.raw
  modified_base (585)..(585): a, c, t, g, unknown or other
  misc_feature (585)..(585): n is a, c, g, or t
  modified_base (679)..(679): a, c, t, g, unknown or other
  misc_feature (679)..(679): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaatggacgtggggtgtactgtaacagccctgctggcgagagggaccagggccaccggtccctaccgagggacgcccatcgctgacgaaggtccgggccaggacggtcgcccctagaccgtgaacggccaagtacgacgaacccaagacgaacggacctaaggtcgggttcgtggaccggaccctagggaggacggtaccgcgggacccgtcggtcccgaggtcacggccggtccgtccggcccctcgcgtcggcgtggccgtgggttcacgggtctaggtccggttccgacccgtagtccggtccgtcggccgtaccggaccgtccccttaagggttccggttacgaccgtaacccgggaccgaaccgggacccggggtaaccccacgggtaccccgtgggaaccgtccccgngttaaccggtggaaccgtcccgaccgggtaccgtaccgtacccgtacggtacccggccggtaccggtcgggtacccggtggggttacccggggngtaaccggggtccgaaccccggaacccgaaccggacccccgacccgttactaccggtcctacccggttcccgttacccccggg

SEQ ID NO: 18438 - DNA, 745 bp, Homo sapiens
  misc_feature: GYAE6OF01CWIND.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (268)..(268): a, c, t, g, unknown or other
  misc_feature (268)..(268): n is a, c, g, or t
  modified_base (368)..(368): a, c, t, g, unknown or other
  misc_feature (368)..(368): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgaggagggaccagggcaccgtcctccgagggancccatgctgcaagtcgggccaggaggtcncccctagaacctgaacggtccaaatcgacgaacccaagacacggccgaagtgggttgtagacgacccgtggacggagtccgtcgggccgtcggtacccgnggaccacggccgccgttcgggccccctggtcctcggcgtcgtcggtcgggtcgtacggtcctaggttccggtaccgtcccgtacgtcgggccctcggtaccgtccggaccgtaccccgtaaggttcggttaccgccgtaaccggaacgaaccgggcccgggaacccgacgacccgttacggacgtacccgttacgtacgggttacggaacgtccggaacgtcccgaacgtcccgaggcccgttagggcccgggtacgtccgggttacgggcggggtaccgtaacgggtcccggaaacccggacccccggaaacccggtcccccctaaaaccccggtacttacccggtaccctaacccgtttccccggttacccccgg

SEQ ID NO: 18439 - DNA, 819 bp, Homo sapiens
  misc_feature: GYAE6OF01A3U3S.14.70.G04.1.454.CMB.1.raw
  modified_base (208)..(208): a, c, t, g, unknown or other
  misc_feature (208)..(208): n is a, c, g, or t
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacacgtcctgcgtcggngaggacggacgcggccaccgtccacggagggccgcctagcgcgtcgacgtaacgggtccggacgaggtacggtccacccgtaacgtaccgtaggaaccggacctaagtcggaaccgaaccgaagaccgacggtaccgtaaggggttgggttacggtacggaacccgttaccgtagggaacggtcgtcgggtcccgggtcccgttcgggacccggacggaccgacggtccgtacccggtcccggtccgttaggccgttacggcgtcggttccggtcggttccgacggtcctacggttcggcccctaccgngtccggtcncgtccgtcgcccgttaccgtaggttccgtacggcccgaccggtaaacgggacccggggtaacccgggtaccgaaacccggtccgggtaccggtacgtacccgttaggtaaccggggtacgtaacgcccgggtaacgtaccctaccgttaccggaaccgtccggacggtccggtaccgggtccggtaggggtaccggccggttaaccggggacccgaaccccgggtaccgaaaccccggacccccgtaaccgtttcgacccgttaaccctcccggttcccgtttaaccccccgg

SEQ ID NO: 18440 - DNA, 823 bp, Homo sapiens
  misc_feature: GYAE6OF01B9UEI.14.70.G04.1.454.CMB.1.raw
  modified_base (193)..(193): a, c, t, g, unknown or other
  misc_feature (193)..(193): n is a, c, g, or t
  modified_base (410)..(410): a, c, t, g, unknown or other
  misc_feature (410)..(410): n is a, c, g, or t
tcagcgtctagtaccacgaccggtgctcgatttagtgtagtgtgaaggggaaaggggagggcagttggtagatcgcccctctgggagagactccccgagggggtgacagccatggaccctgggaagggcctggctagggacagggaccagagccagtccagggagagacagacgaccaagtggacgtggggtntacgtgtaacacgccctgcgtggcgaggacgggaccgagggcacccgtcctcgagggacgcctatcgctgcgaaggtccgggcaaggcggtccgtcccgagtaacccgtaggaaccggaccaagacggaacgaacccgaagacgacggaccgtaggttgggtcgtacgaccgtacccgtaggacgggacgcggtccggggccctcgggtaccccggnggtcccgacggccgtcccggtccggtccccgtcggcctcggtcgtcggaccggttcggtccttaccgtggggtaccctcgggtccggtcccgaccggtaccggtcggcccgttcggtacccgtccgggacccggtaccgttaacgggtccggttaccggacccgaacccggaccgggtaaacccgggaccgggtaccccgaaccggtacccggaccggtacggtaccgtacgggtacggtaacacggaccggtaccgaccggtaccgaccgtaccggtacccggacgggcccgggtacgggtcccgtacggggtacgggaacccggtacccggcccgaacccccggaaccccggtaacccggaaccccctacccgttaccgttacccgtccccgtttaacccggttccccccg

SEQ ID NO: 18441 - DNA, 825 bp, Homo sapiens
  misc_feature: GYAE6OF01EDPFL.14.70.G04.1.454.CMB.1.raw
  modified_base (190)..(190): a, c, t, g, unknown or other
  misc_feature (190)..(190): n is a, c, g, or t
  modified_base (249)..(249): a, c, t, g, unknown or other
  misc_feature (249)..(249): n is a, c, g, or t
tcagcgtctagtaccacgaccggtgctcgatttagtgtagtgtgaagggaaagggggagggcagttggtagatgccccctctgggagagatccccagggggtgacagccatggaccctggaagggcctgggctagggacagggaccagagccagtccgagggagaggacagagccaatggacgtggggtntactgtaacagccctgctggcgaggacgggaccagggccacccggtcctccgagggacncccatgctgacgaaggtccgggaccaggacggtccgccccgtagaaccgtggaacggacaagtgaacgaacccaaaggacgacggaccgaaagggttcgggttggtacggaaccggaccccgtagggaacggacggtccggtccggggtccccgttcgggtaccccgaaggccgacggccggtccgtccggcccctggccgttcgcgtcggcggttcgggtccgtcggccgtacggtccgggtccccgtacccgtggtcccggtccgtcgggtccgtccggcccgtacccgttaaggttccgggtccgaacccgaaccggtaccgggaaacccggggacccggggtaaccccgaccggtaccccggtacggacccgtaccgtaccgtacgggttacggaacgcccgtacggaccgtacgacccgacgtcccggtacggccgggtaccgtccgggtcgggtacggggccgttaacgggggtaccccacccgggtaaacccccggaacccggtaacccccccgaaccccgggttacccgttaccgtaccccgttcccgttcccccggttaccccccgg

SEQ ID NO: 18442 - DNA, 815 bp, Homo sapiens
  misc_feature: GYAE6OF01CWYMD.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggacgcccatgctgcaaggtccgggcctaggacggtcgcccctagaaccgtggaacggccaagtacggaacgaacccaaagacgaacggaccgaaaggttggggttcgtacggaccgtaccccgtggaacgggacgacggtccggggcccgtcgggtaccccgaggcgacggccgccgtcggcccctgcgtcgcgtcgcgtcggtcgtcggccgtacgtcggtccgccgtacgtccggccgtcgccgtcggccgtaccgtaacggttcggttcggaccgaacccggaaccggaaacccgggacccggggaaccccgtaaccggaccccggtacgggacccgtcccggttaaccggtacgggttaacgggaaccggtaccggaaccggtacccgaaccgtcccgtaccggtaccggtaccgggaccgggtaaccggtcccgggttagggtaccgggggtaccggtaaccggggttacccggaacccgggaaccccccggtaaacccggacccccgtaaaaccccccggttaccggttaaccccggttacccgtaacccggtttccccgtttaaccccccgg

SEQ ID NO: 18443 - DNA, 757 bp, Homo sapiens
  misc_feature: GYAE6OF01AO4H0.14.70.G04.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagcgtctagtaccacgaccggtgctcgatttagtgtagtgtgaagggaaagggagggcgagtggtagatgccctctgggagagatcccagggtgacagccatggaccctggaagggcctggctagggacagggaccagagccagtccaggagaggacagagccaagtggactggggtgtactgtaacagccctgntggcgagcggaccagggcctaccgtcctcgagggacgcccatgctgcagtcggcagacggtnccctgactcgaagccaatcgagacccagacgagccaagtgggttgtgacgcccgtgacgagctcggggcctcgggtacccacgggctacggccgctacgggtcccctcggtcgtccgtcgtcggtacggttcgggtccgtcggggcccgtaggttccgggtaccgcccccgtggtccgtccgggttcgccgtacggtacccgtcccgtaaggttccggttcacccggtaccggacggaaacccgggaccggggttaccccgaaaccggtaccggtaacccggcggtaccggtacccgtaagggttccggaaacggttaccgaccggacccggttaccgtaccggtacggtacccggttccgggaccgggtacggttccccgggtagggttaacccggggcggttaaccgggttccggaaccccgggtaacccgaaccgggaaccccgtaaaccccggccgttaaccgggtacccttacggtccccgtttaaccccggg

SEQ ID NO: 18444 - DNA, 653 bp, Homo sapiens
  misc_feature: GYAE6OF01BJJKS.14.70.G04.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (521)..(521): a, c, t, g, unknown or other
  misc_feature (521)..(521): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
tcagcgtctagtaccacgaccggtgctcgatttagtgtagtgtgaagggaaaggggagggcagttggtagatgcccctctgggagagatccccgagggtgacagccatggaccctggaggcctgggctagggacagggaccagagccagtccgagggagaggacagagaccgaagtggacgtgggtntacgtagtaacngccctgctggcgagaggcaggcaccgtccncgaggacgccatgctgacgacggtccggaccaggacggtcgccccgtagaacctaggaacgaccaagtacggaaccgaacccgaagacgaacggaccgtaaggttgggttcgtacggaccgaccccgtggaggtacgtcggtccggtcccgtcgggtacccgaggaccgaccggccgtacgtccgccgtcgcgtacgcgtcgtcggtcggtcgcgacgngtccgtacnccgttgcgtccgngcgcgccgtacgtagtcgtcgccgaacgccgaacgccggacacgtcggacncgtactcgtacggtnacggcgacgacgtccncgacgccgaggccggtcgtacggtcgggaccggcgtaacggccgtacggacccgaaccggacccctaccacgtcccgtacgtccctaacggttcccccccg

SEQ ID NO: 18445 - DNA, 753 bp, Homo sapiens
  misc_feature: GYAE6OF01A3BPN.14.70.G04.1.454.CMB.1.raw
  modified_base (242)..(242): a, c, t, g, unknown or other
  misc_feature (242)..(242): n is a, c, g, or t
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggacgtggggtgtactgtaacagccctgctggcgaggagggaccagggccaccgtcctcgagggacncccatgctgcaacggtccgggccaggacggtcgccccgtagaaccctggaacggccaaagtcgaagacccaagaccaggaccaaggtgggttgtgacgaccccgtggaggagcgtcgggccctgggtcccaggcagccgccgtcggtcccctcggtctcgtcgtcggtccgtcgggtccgtacggtcctagtcgggtccgccccgtagtcgggtcctcgccgtcggccgtacccaagttcggttacgccgaccgtaacgaaccgggtacgggacccaccggtacccgcggacgtcccgtacgtacggtacggtaaccgccggaacggtaccgtaccgttaccgcggtacccgttacggcccgggtaggtccccggttggggttacccgggggccgtacgggggtaccccgtaacccgggacccccgaaaacccggggtacccccccgtaaaacccccggtacccggttaccgaaccccgtaccccggtttccccggtttaacccccccggg

SEQ ID NO: 18446 - DNA, 798 bp, Homo sapiens
  misc_feature: GYAE6OF01AEBVN.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaagtggacgtggggtgtacgtgtaacagcccgtgctggcggaggacgggaccgagggccaccgtccgtaccgagggacgcccatgctgacgaacggtccgggaccaggacggtcgacccgtagacctaggaacgaccaagtcggaacgaccaagacgacggaccgtaaggtgggttacggtcgaccgtacccgtaggacggacggtcggtcgggcccgtcgggtacccgaggtaccgcgggacgtcccggtccggccccgttacgtccgtcggcgtccgggttcggtacgggttccgtcggtacccgtacgggtccggtacccgcccggtagtcccggtcgtaccggtccgtcggaccgtaccgtacggttacggttaccggacccgacccggtaacggaaccggggtacccgggaacccgtaccggtacccgggaccggtacccggtacggtacgtaacggggtcgtaaaccgcggaaccgttccgaccgtcgtaccggtaccgtccgggaccggttccgtacgggtccgggtacgggtacccgacggtccggaaccgtaccccgggaaacgaccccgtaacccgtaccgttacccggaacccgttcccggtaccgtttccccgg

SEQ ID NO: 18447 - DNA, 649 bp, Homo sapiens
  misc_feature: GYAE6OF01ARZ2M.14.70.G04.1.454.CMB.1.raw
  modified_base (552)..(552): a, c, t, g, unknown or other
  misc_feature (552)..(552): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggaggtcgcccctgaaccctggaacggccaaatgacgaacccaagaccaggccaaggtgggttgtgacgcccctggaggagcgtcgggccctgggcccgaggcacgccgcgtcggcccctgccgtcgcgtggccgtgggtaccgtgggccacgtcgggtccgtacccgagttcgggcccgttcgccgtcggccgtccccgtaagtcgggtttaccgccgtaacccgaccggaaccggaccggggacccacggacccgtcgggacgcctcggagttaggacgcgacgtcgacnccgagccgtcgcgtacgccggtgggtccgggcgtcggtacgcggacccgaccggaccccgaaccccgacctccggtacctccgtcccgttaccccgg

SEQ ID NO: 18448 - DNA, 775 bp, Homo sapiens
  misc_feature: GYAE6OF01CEOC1.14.70.G04.1.454.CMB.1.raw
tcagcgtctagtaccacgaccggtgctcgatttagtgtagtgtgaagggaaaggggagggcagttggtagatcgcccctctgggagagactcccgaggggtgacacgccatcggaccctggaagggccgtgggctagggacgagggaccagagccagtccgaggagaggacagacgacaagtggacgtgggggtcgtacgtacgtaacgacgccccgtgcgtgggaccggaggaacgggaccgacggggccaacccgtccgacccgagggaccgcccgtagtcgccgtgacgacggtccgggaccaagggacggtccgaccccgttaggaacccgtaggaaacggtaccaagtacggaaaccgaacccgaaacggaacgaacggaccggtaaagggttcggggttacgaccggaccggtaaccccggtaggaagggacgtccgggtaccgggcccgtacggtacccggaggccgacggccgtccggtcccggccccgttgcctcggccgtcggtacgtcgggtcgtcggaccttcggcccggccgtacgacggtccggtcgcggtcgccggcgtcccgtaagtcggtacgaccaacggacggaaccgggccggaaccacggccgtaccgtacgtacgaccggtagtaacggacgtacgaacccgtcgacctcgaccgtcgacgggtccgacgtccggaggtacggccgtaaggcccgacccggacccgtaaccgaccccgtcccgtaactccgtacctccggtcccttacccccg

SEQ ID NO: 18449 - DNA, 627 bp, Homo sapiens
  misc_feature: GYAE6OF01E0NJ2.14.70.G04.1.454.CMB.1.raw
  modified_base (186)..(186): a, c, t, g, unknown or other
  misc_feature (186)..(186): n is a, c, g, or t
  modified_base (342)..(342): a, c, t, g, unknown or other
  misc_feature (342)..(342): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggggtntactgtaacagccctgctggcgagagggaccagggcaccgtcctccagggagcccatgctgcaaggtcgggccaggaggtcgcccctagaacctgaacggccaatagacgaacccaagacgaggccgaaggtgggttgtggacgacccgtggaggngcgtcgggccctcgggtccaggcacgcgcgtcgccctgctgctgcgtggtctggctagtcggtcgcctgtcggctgctcgccgcctagtggtcncgtaccgagaacggccgggaccacgacccgnggccaccgtcgtaggtacgaacgcgaggcccgacgtcgacggccgtcggccgggtacgtccggtagggtaccgggggtcctaacggggaccgaacccggacccgaaccgggtaccccctaaccccggactacccgtacccgtccctcccggttacccccg

SEQ ID NO: 18450 - DNA, 828 bp, Homo sapiens
  misc_feature: GYAE6OF01BKEVV.14.70.G04.1.454.CMB.1.raw
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaagtggacgtggggtgtactgtaacacgccctgcgtggcggaaggacgggaccagggccacccggtcccgtccgacgggacgaccccagtgccgtagaccgaacggtccgggacgaggtacggtccgccccgtaagaaccgtaggaacggacctaagtacgaacgaacccgaaggaaccgacggtaccgaagggttcgggttagtacgaaccggtaccccgtagggaacggacggtcggtccgggcccgttaccgggtacccgagggcgacggtccgtccggtcccggtcccggtcgtccgtcggtaccgtcgggtccggtcggggttccgtcgggtaccgtacggtccgggtacccgtcccgtaaggtccggtccgtcggccgtaccgccgtaccgtaggttccgtacggaccgtacggaaccgaacgggaccggtacccgaaccggtaccggtcggaccgcccgtaggtacggttacgaaccggtaccgacggaccgtaccgtaccgaccggtccggcgggtccggaaccggttccgggtacggggccggggtaccggtacggtaacccggaccgggaacccccgaacccgggaaccccctaccccggtaccgttaccggtccccgtaacccggttcccgttaacccccccggg

SEQ ID NO: 18451 - DNA, 606 bp, Homo sapiens
  misc_feature: GYAE6OF01AQ7J3.14.70.G04.1.454.CMB.1.raw
  modified_base (237)..(237): a, c, t, g, unknown or other
  misc_feature (237)..(237): n is a, c, g, or t
  modified_base (338)..(338): a, c, t, g, unknown or other
  misc_feature (338)..(338): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaaggtcgggccaggaggtcgcccctgaacctgaacggccaagtgacgacccaagacgaggccaaggtggttgtgacgaccccgtggacggngccgtcgggccctcggtccccgaggcgacggccgtcgtcggcccctgcctgctcggcgtgggtctggccgagtcggtccgcccagtcggcctgcgtcgcgtccagtcggtcgccgacgacgaacggccggacccacgaccgtggactcccgtgacgtcgaacgccgacgccgactcgaccgcgtcggacggcgtccgtgggtaccgggcgacgggtcgaccgtacccgaacggaccccacccgactcgccctaccgtcgttacccccg

SEQ ID NO: 18452 - DNA, 732 bp, Homo sapiens
  misc_feature: GYAE6OF01D0N4M.14.70.G04.1.454.CMB.1.raw
  modified_base (402)..(402): a, c, t, g, unknown or other
  misc_feature (402)..(402): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggacgtggggtgtactgtaacagcctgctggcgagaggaccagggccaccgtcctcgagggacgccatgctgccaaggtcggccagaggtcgccctagactgaagccaatgacgaccaagacgacggaccaagtgggttgtacggacgacccgtggaggacgtcgtcgggcctcggtccaggcacgcgcgtcggcccgtgctcgctggtcgtgggtcctcggaccgngtccggtcgcccgtagtcggtccgtgccgtcggaccgtcctaagtcgggttacgaccgtaccggacggaaacggacccgggggaaccccacgggtaaccccgtacggggaacgtccccgttacggtacgggttaacggaacggccggaaccggtacccgaccggtacctacggccccgttagggaacccggtcgggtacccgttgggggtaccgggggtaccggtaaccgggtaccggaaaccccgggtacccccgaaacccgggaaacccccgtaaccccgttaccggacccggtaccccttaacccggtcccgtttaaacccccccgg

SEQ ID NO: 18453 - DNA, 598 bp, Homo sapiens
  misc_feature: GYAE6OF01D8QNK.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagacccaagacaggccaagtcgggttgtggacgaccccgtggaggagcgtgggccctgggtcccaggcagcgctcggccctgctgctgctgggtctggccagtcggtcgcccgatcggcctgctcgccgcccgtaagtcggttcgccgtaccgacgaaacgggccgggaacccacggacccgtcgacggggcctcgaggttcggaacgcgacgtcccgactccgaacgccgtggccggagtccgtaggtcggggcgtaggcgacgcccgaaacggccccaacccgtactacggctaccgtcgttaccccg

SEQ ID NO: 18454 - DNA, 602 bp, Homo sapiens
  misc_feature: GYAE6OF01AC5HJ.14.70.G04.1.454.CMB.1.raw
  modified_base (339)..(339): a, c, t, g, unknown or other
  misc_feature (339)..(339): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
tcagcgtctagtaccacgaccggtgctcgatttagtgtagtgtgaagggaaaggggagggcagttggtagatgcccctctgggagagatccccagggggtgacagccatggaccctgggaagggcctgggctaggggacagggaccagagccagtccagggagaggacagagccaatggacgtggggtgtactgtaacagccctgctggcgaggacgggaccgagggcaccgtcctccgagggacgcccatgctgcaaggtcgggccaggaggtcgccctagaacctggaacggccaagtgaacgacccaagacaggccaaggtgggtgtgacgacccnggacggagcgtcgggccctggtcccgaggcacgcgctcggcctgctgctgcgtggtctgcagtcgcgccgagtcggctcgctcgcgacctagtcgtcncaccgagacggccggacncgaccgngacncgcgtaggtggaacgcgacgtaccgacgtccgacgtcgtcgaccggcgtccggtgggtcggggacgcgggtacctacccgggacccgaacccggaccccgtaaccgcgtaccgtaccgtcccgtcggttacccccg

SEQ ID NO: 18455 - DNA, 846 bp, Homo sapiens
  misc_feature: GYAE6OF01CDMEQ.14.70.G04.1.454.CMB.1.raw
  modified_base (245)..(245): a, c, t, g, unknown or other
  misc_feature (245)..(245): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactagtaacagccctgctggcgaggacgggaccagggtccaccgtcctccgagggacncccatcgctgacgaaggtcgggcaggacggtcgccccgtagaaccgtggaacggccaagtcggaacgaacccgaaagacgacgggacccgaagggttggggtttcgacggaaccggtaccccgtaggacggacgtccggtacggggtcccgttcgggacccgaagggccgacggtccggccggtcggtcccccgtggtccgtcggtccgtcggtccggttcgggtccgtcggtccgtagtccgggtccgcccgtagtccggtccgttcggaccgttccggaccgtacccgttaaggtccggttacgacccggaaaccgaccgggaacccgggtaccccgggaaccccgtaccgggacccggtcgggtaaacccgtccggtaaccggttacgggtacggaaccggaccggaaccggtacccgttaccgaccggaccgtcccggtaacggggtccggaaccggtccgggtacggggtaccgggtaccgggtaccgggtacccggaaccccggaaccccgggtaaacccggaacccccccgtaacccgggttaacccgttaccccggttaacccctcccggttaccccgtttaacccccccggg

SEQ ID NO: 18456 - DNA, 723 bp, Homo sapiens
  misc_feature: GYAE6OF01AMKT9.14.70.G04.1.454.CMB.1.raw
  modified_base (358)..(358): a, c, t, g, unknown or other
  misc_feature (358)..(358): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgaggaggaccagggctaccgcctcgagggagcccatcgctcgcaagtcgggacaggaggtcgccccgtgaaccgtggaacggccaagtgaacgacccgaagacgaaggaccctaaaggttggggttgtacggacgaccccgtggacgggacnccggtcgggcccgttcggaccccgaaggccgtaacggccgtcggtaccggtccccgtggcctcggtcacggccggttgggtaccgttcggccgtagtcccggggaacgtccccgtggtaccgggccgtcggtccgccggtaccgccgtaacgttcggttaccgccgtacccggaaccgtaacggggccgggaacccgtccgggacccttacgggaccgtacccttacgggtacgggttaccgaacggtacccgacgggtaccgacgttcccggaactccgggtacgcgggtaccgcggtaggtccggggactaggccgacggcccgacgtaccccaccgtccgactccgtccgtaccgttccccg

SEQ ID NO: 18457 - DNA, 622 bp, Homo sapiens
  misc_feature: GYAE6OF01BDL0S.14.70.G04.1.454.CMB.1.raw
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaagtcgggcaggaggtcgcccctgaacctgaaggccaagtgaacgacccaagacaggccaaaggtgggttgtggacgtacccctggacggagcgtcgggccctcgggtcccaggcagcgcgtcggccctgctgctcgctgggtctggccagtcggtccgcccagtcggcctgccncgccgcctaagtcggtacncaccgacgaacgggccgggacccacggacccgtagggaccgtcctacgacggttacggaacgtcgaacgtcccgtaacgtccgacgccgtaggcggaccgtccgtgggcgggtctagggtccgacggaccccgaacggaccccgtaacccgacgtcccggtcacccgttcgttaccccg

SEQ ID NO: 18458 - DNA, 773 bp, Homo sapiens
  misc_feature: GYAE6OF01B8Z15.14.70.G04.1.454.CMB.1.raw
  modified_base (571)..(571): a, c, t, g, unknown or other
  misc_feature (571)..(571): n is a, c, g, or t
tcagcgtctagtaccacgaccggtgctcgatttagtgtagtgtgaagggaaagggggagagaggagcccagccctgggattttcaggtgttttcatttggtgatcaggactgaacagagagaactcaccatggagtttgggctgaactggcttcttcttgtggctattgtaaaaggtgtccagtgtgaggtgactacgtggtggagtcgggtagggggacggtcgttggtacgacgtccgggtacggggtaacctaaacctctccgtacgtaacctaacctgagtcttccgtcctttcgactattctagtccgactagtcggccggtcgggtccgacgagtaccgttaccgggaagggggacgggtcgtggggaggtaggtactccgtactaaacttaggttagggtaggtaagggtgggtaggtggtagaactccgaactaattaacgtacgcgagtccttcgtggtacgggaaccgggtccgttaccacgtactcccgacgaagaacaacttaactaacccaaaccaactaacctttaacttatccgactaaactaacgtaacgaaacnccgtacctacggaccgtacggaaccgggaagaccccggaccggttaccttaaattaacgttccgtaggtaccgaacgtaaaggacgtaacgaacccggaacgggtaccccggggacgggttaacgggccccgtttacccggtaacgggtaaacccgttcgggggacccgggaaacccggggtaaccggtaaacccgttacgg

SEQ ID NO: 18459 - DNA, 844 bp, Homo sapiens
  misc_feature: GYAE6OF01DRRGX.14.70.G04.1.454.CMB.1.raw
tcagcgtctagtaccacgaccggtgctcgatttagtgtagtgtgaagggaaaggggagggcagttggtagatgcccctcgtgggagagactccccgaggggtgacagccatggaccctggaagggcctgggctagggacagggaccagagccagtccgagggagaggacagagccaagtggacgtggggtgtactagtaacagccctgctggcgaggaggaccgagggccaccgtcctccgagggacgcccagtcgctcgacgaaggtccgggaccaggacggtccggaccccgtaggtaacccgtacggaacggacctaaagtacggaacgtaacccgaaacggaaccgacggaacccgtaaagggttcggggtttacggtaacggtaccggtaacccccggttggacgggtacggaccggtccgggtacccggtccggtacccggacggccgacggccggtccgtcgggcccccgtgccgtcggtccgtcggtccgtcggggttccgtccggtccgacggttccgggtccccggacccgtacggttccggccgttccggtccgtccgggaccccgtaccgttacggtcgggttacccgcccggaaccgtaaccggaaccgggtacccgggtacccgaaccggacccggtcgggaaccgtccggtaacgtacggttacggaaccgcggacggtacccgacggtacccgaccgtccggtacggacgaccggttccggtaccggggtaccggtccgggtaccggaacccgtacccggaccccgaacccggtacccctaaacccggtcgttacccgtccgttaacccgttccccggttacccccgg

SEQ ID NO: 18460 - DNA, 862 bp, Homo sapiens
  misc_feature: GYAE6OF01E4BOJ.14.70.G04.1.454.CMB.1.raw
  modified_base (188)..(188): a, c, t, g, unknown or other
  misc_feature (188)..(188): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaagtggacgtggggtntactgtaacagccctgcgtggcgaggacgggaccagggcaccgtcctaccgagggacgcccagtcgccgtggacaacggtccgggccaggtacgggttccgcccccgttaggaacccgtggaaacggcccgtaaagtacggtaaccggtaaaccccgaaacggaaccgacggggaacccgaaagggtttacgggggtttcggttacgggaaccggaacccccgttagggaacgggtacggtccggtacggggtccccggttaccgggtccccgaacgggccgacggccggtccgtaccggtcccccgtgtccgtcggaccgttcggtccggtcgggttccgtacgggtccctacggtcccgggttccgccccggtagttcccgggtccgttacggccgtcgtccccggacccgttaacgtcgggttaccgcccgaacccggacgaacccggggtaccgggaaccccgtaccggtacccggtcggtaaccgtcccgtaacggtacggttacgggaacgtccgacgtcccgaccgttccgacggccgtacggccggtacggcccggtcggttaccggggcgtaccgggaccggtacccggaaccccggaaaccggaccccccgttaaaccccgtacggtaccccggttccccgtaccgtcccccggtttaaccccg

SEQ ID NO: 18461 - DNA, 756 bp, Homo sapiens
  misc_feature: GYAE6OF01EC9YT.14.70.G04.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
tcagcgtctagtaccacgaccggtgctcgatttagtgtagtgtgaagggaaaggggagggcagttggtagatgcccctctgggagagactccccgaggggtgacagccatcggaccctgggaagggcctgggctagggacagggaccagagccagtccaggggagaggacagacgaccaagtgggacgtggggtntacgtagtaacacgccctgcgtggcgaggacgggaccagggccaccgtcctacgagggcncccgatcgctacgacgaacggtcggaccaggacggtccgcccgtaggaaccgtaggaacgacaagtacgaacgaaccaacgaacgacggaccgtaaggtgggttagcggacggtacccgtggacggacggccggtaccgggcccgtcgtcccgaggccgacgccgccgtccggcctcgcgtcggcgtcggtccggttcgggtccgtccggtcgtacggtccggtcccgtccgtaccggtccgtccgtgtcccgtacgacccgtccgtaacggttccggtacgtacccgtaacggaacccgggaacgggccccgggaacccgacccggtaccggacggtacccggtacgtacgtaacggtacggaaccggacgacggtaacccgcgaccgacgtccggcggcgtaccggtcggtacgggacgggtccgaggtacccggacccggaccggaacccgaaccccgtacccgtccgaccgttccgtcccgttcccggttacccccg

SEQ ID NO: 18462 - DNA, 651 bp, Homo sapiens
  misc_feature: GYAE6OF01CEV6R.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccagggagaggacagagccaatggactggggtgtactgtaacagccctgctggcgagagggaccagggcaccgtcctccagggacgcccatgctgcaagtcggcagagtcgccctgacctgaagccaatgacgaccaagacaggaccagtgggtgtgacgacccgtgaggagcgtcgggccctggtcccaggcagcgcgtcgccctgcctgctgcgtggtctcggcctagtcggtccgccgacgtcggccgttcgccgtcggaccgaccctaagttcggttacgccgaacccggtacggaaaccgggcccgggtaaccccgaaccggtaccccgtggaaccgtcccgtaacgacgggttaacggaacgccgtaacggccgaactcccgacggcccgtcgggacggtaccgacccgtgggaccgggcgtacgggtaccgccgggtaaccccaaccggaccccgaacccgtaccgtcgtacccgtccgttcccgttccccgg

SEQ ID NO: 18463 - DNA, 858 bp, Homo sapiens
  misc_feature: GYAE6OF01CIDCK.14.70.G04.1.454.CMB.1.raw
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagaggacagggcaccgtcctccgagggacgcccatgctgacaaggtccgggaccaggacggtcgcccctagaaccgtgaacggccaaagtacggaacgaacccgaaagaaccgaacgggacccgtaaaggttggggtttacggtacggaaccggtaacccccgttgggaaacggggtacgccggtccggggtccccgttacgggtaccccgagggccgacgccggtccggtccggcccccgtggccgtcggtcgtcggtcgttcgggtccgtcggcccgtacgttccgggtccgcccgtagtccggtcctcgtccgtcggacccgtacctaaggttcgggttaccgacccgtaacccggaccggaaccgggaccccggggtaacccgaaccgggtaccccggtacgggtacccggtacccgttaccgggtaacgggtttaaccgggaaccgtaccggtaacccggtacccggtaacctaccccggtacgggtccccgtacgggtaccgggtacccggttcccgggttggggttaccgggggacccgttaacggggtacccggaaccccggtacccccggaaacccgggtaaccccctaaaccccggtaccggttacccgtaccgttaccccggttcccgtttaaccccccgg

SEQ ID NO: 18464 - DNA, 783 bp, Homo sapiens
  misc_feature: GYAE6OF01EJTO9.14.70.G04.1.454.CMB.1.raw
  modified_base (186)..(186): a, c, t, g, unknown or other
  misc_feature (186)..(186): n is a, c, g, or t
  modified_base (242)..(242): a, c, t, g, unknown or other
  misc_feature (242)..(242): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggactggggtntactgtaacagccctgctggcgagagggaccagggcacccggtcctccgagggacncccatgctgacaaggtcggccaggacggtgcccctagaacctgaacggccaatgacgacccaagacaggccaagtgggttgtgacgaccccgtggacggacgtcgtacgggtccccgtcggtccccgagggtccaacggccgtcgttaccggcccccgtaggtccgtacggccgttcggtcccgttcgggggtccttaaccggggcccttaacgtccggggttccccggacccctaagggttccgggtccccgttacgggtcccgttacggacccggtaccccgtaaaggttcgggtttacggaccggtaacccggaccggtaaaacccgggccccgggggtaaacccgaccggtaccccggtacgggaaccgtcccgtaccggtaggtacgggtaacgcgaccggaccgtacgttcccgagtcccgtacggcggtaaccgtccggtgggtcggggaccgtacggtaccggaaccgccccggaaaacggtccccccaaaacccgtccggtacgttaccctaaccgtcccgtttaaccccgg

SEQ ID NO: 18465 - DNA, 753 bp, Homo sapiens
  misc_feature: GYAE6OF01DPTFD.14.70.G04.1.454.CMB.1.raw
  modified_base (192)..(192): a, c, t, g, unknown or other
  misc_feature (192)..(192): n is a, c, g, or t
  modified_base (267)..(267): a, c, t, g, unknown or other
  misc_feature (267)..(267): n is a, c, g, or t
  modified_base (727)..(727): a, c, t, g, unknown or other
  misc_feature (727)..(727): n is a, c, g, or t
tcagcgtctagtaccacgaccggtgctcgatttagtgtagtgtgaagggaaaggggagggcagttggtagatgcccctctgggagagactccccgaggggtgacagccatggaccctgggaagggcctgggctagggacagggaccagagccagtccgagggagaggacagagaccaagtggacgtggggtntactagtaacacgccctgcgtggcgaggagggaccaggtccgaccgttccaccgagggaccgcccatcgctacgngaacggtccgggaccaggacgggttccaccccttagaaccgtacggaacggaccaaagtcggaagaacccgaagaacgtaacggaccaagggttgggttacgacgtacgcccgtaggaacggacgtccggacggtcccgtcggtacccgaaggcgacggcgtaccgtcggtccccgtgaccgtcgtaccgtcgggtacgtcgggttccgtaacggtcccgaacggttccgggtccccgtacccgagttcgggcccgtagcccgtcggcccgtacccggttagtcggttaccgacgtacccggaggaacccgggaccggggtacccaccgggtacccgtacggccgtacgtacggtaggtcggaacgtcgaacgtccgaccgtacgaccgacgtcggaacggcctcggtacgggcggtaacggcggtaccggaccgaccggtaacggaccccgtaaacccncgtaaccgactcccgtccgtaccccg

SEQ ID NO: 18466 - DNA, 742 bp, Homo sapiens
  misc_feature: GYAE6OF01DBDBX.14.70.G04.1.454.CMB.1.raw
  modified_base (725)..(725): a, c, t, g, unknown or other
  misc_feature (725)..(725): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccagggagaggacagagccaagtggactggggtgtactgtaacagccctgcgtggcgaggaggaccagggcaccgtcctccgagggacgcccatgctgacgaaggtcggcctaggacggtcgcccctagaacctgaaacggccaagtcgacgaacccaagaccacggaccgaaggtcgggtgtacggacgacccgtggaggacgtcgtcgggccctcggtacccgacggcgacgccgaccgtcggcccgtgccttagcctggcggttcgggtacgtcggtacctaggttccggccgccgtacggttcggtaccctcgggtaccgtaccggaccgtacccgttaaacgggttcggtttaccgacccggtaaacccggaaccgggtaaacccgggggaccccggggttaaccccaaccgggtacccccggttacgggaaccgtcccggttacggtaacgggttaacggaacgtacccggaacggtcccgaacgtccgtacgccgtcggaccgtacgcggtggccgggtacgacggtaccacggaccccgaagacccccgaacccgtctccgtaccnccgttcccgttaccccg

SEQ ID NO: 18467 - DNA, 803 bp, Homo sapiens
  misc_feature: GYAE6OF01E2GFM.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgcgtggcggaggacgggaccgacgggccaccggtcctccgagggacgcccagtcgctgcaacggtcgggaccaggacggtcgaccccgttacgaaccgtacggaacggaccgtaaagtcggaaccgaacccgaaggaaccgaacgggacccgtaagggttacggggtttggtacggaaccggtacccccgtagggaaccgggacggtccgggtaccggggtccccggttaccggggtaccccgacgggccgaaccgggccggtcccggtcccgggtccccgtcggtccgtacggccgttcggtcggttcgggttcgtcggtcctacgggtcggtacccgtccgtacgtcggtccgtcgccgtcgccgtaccgtggtcgtacgaccgacggacgaacccggggccggaacccgaccgtacccggacggaccgtaccggtagacgttaggaacgtacgaccggtacccgaccgttccgacggtccgtaccgggtacggccggttaccggtcggggtcgggtaccgtaccggggtacccaccgggaccccgaaccccggaccccgtaaccgtccgttaccctacccgtcccgtcccgttacccccg

SEQ ID NO: 18468 - DNA, 749 bp, Homo sapiens
  misc_feature: GYAE6OF01B2YN9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccgagggcaccgtcctccgagggacgcccagtgctgcgaacggtccgggccaggacggtcgccccgtgaaccgtaggaacggacctaagtcggaacgaacccaaagacgaacggcctaaaggttggggttagtaggaccggtaccccgtagggacggacggtcggtccggggtaccccgtcgggtacccccgagggccgacggccggtccgtccggccccgtggccgtggtccgtcgtcgtcgggtctcgggacctaggtccggtcgcccgagtccggcctcggcgtccggccgtacccgtagttcggtccgaccgaaccggacgaaccgggccggtaacccgtacggacccggtggaccgtccggttaccgtagggtacggaacggtacgaccgggtccgacgtccgtacggccgtacgggaccggtacggtccggtacgggtcggggtaccgtaccgggtacgacccggacccgtaacccggaccccctaacccgtaccgtacgtccccgttccgtcccggtttacccccg

SEQ ID NO: 18469 - DNA, 774 bp, Homo sapiens
  misc_feature: GYAE6OF01DFMIH.14.70.G04.1.454.CMB.1.raw
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
  modified_base (755)..(755): a, c, t, g, unknown or other
  misc_feature (755)..(755): n is a, c, g, or t
tcagcgtctagtaccacgaccggtgctcgatttagtgtagtgtgaagggaaagggaggcagtttggtagatcgcccctcgtgggagagactccccgaggggtgacagccagtcggacccgtagggaacggccgtgggcgtagggacgacgggaccagacgccagtccgagggagaggacaagacgaccaagtggacgtggggtacgtactagtaacncgccctgcgtggacgaggacgggaccgacgggccacccgtccgtacgaacgggaccaccgagtcgngtcggacgaacgggtccggacgaacggccggttaccgacccgttagaaccgtacggaacgacctaagtacgaaccgaaacccgaacgaacgtaacggaccggtaaggttgggtaacgacgaaccgtcccggtaaggacgtcgccggccggtcccgttcggaccgacggcgtaccgtccgccggtcccgccgtcgcgtcgacgtggtcggtacggtcggacgacgtcggtacccgtccgacccgtcgtaccggtccgtccgaccgtccgaccgtaccgttaggtccgaccgtacccgaacgaacccggaacgggaccgacccgacgtaccggcggtaccacgtacgaggtaacgaacgcgaccggaaccgtaccgacgtacgcgtcggaccgtacgtccgggacggtcgggtaccgacggacccggaaccgaccggtaccccaacccgggtacccctagtaccccggttaccnccgtttaccccggtccccc

SEQ ID NO: 18470 - DNA, 887 bp, Homo sapiens
  misc_feature: GYAE6OF01B31NG.14.70.G04.1.454.CMB.1.raw
  modified_base (222)..(222): a, c, t, g, unknown or other
  misc_feature (222)..(222): n is a, c, g, or t
tcagcgtctagtaccacgaccggtgctcgatttagtgtagtgtgaagggaaaggggagggcagttggtagatgcccctctggggagagatccccaggggtgacagccatggaccctggaagggcctgggctagggacagggaccagagccagtccaggagaggacagagccaatggacgtggggtgtactagtaacagccctgctgggcgaggacgggaccngggcaccgtcctaccgagggacgccctatcgctgacgacggtccgggaccaggcggtcgacccctaggaacctcggaacggccaagtacgaacgaacccgaaagaccgacggaccgaaggttggggttacgtacggaccggtacccgtagggacggacggtccggtccggggtcccgttcggggaccccgacgggcgaccggcccggccgttccgggcccctggtccgtcggtccgttacggtccggtcggggttccgtacgggtcccgtacggttcccgggtaccggtccccgtacggtcgggtcccgttccggtccggtaccggtaccccgtacccgttaacgggttcgggttaccggacccggaaacccgggtaccgggaaacccggggttaccccggggaacccgtacccgggtaccccgtacgggacccggtaccggtaaccggtagggttaccggaaacgtcccggaaccggtacccggtaaccgtaccccggaacgggtcccgttacgggaccgggttacccgggtaccgggtttacgggggccgggaaaccgggtaccggggaccccggaaccgggttaaacccccggacccgggtaacccccgtaacccccttacgggttacccgacccgttacccgttccccgttaaccccccgg

SEQ ID NO: 18471 - DNA, 1091 bp, Homo sapiens
  misc_feature: GYAE6OF01EJ15I.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagaccaatggactggggtgtactgtaacagccctgctggcgaggagggaccaggccaccgtcctccgagggcgcccatgctgcgaacggtccggaccaaggacggtcgccccgtagaaccgttggaaccggccaaagtacggaacgaaccccgaaagaaccgagggaccctaaagggttcggggtttcggtaggacccggaacccccgttggggaaacggggtacggtcccgggtccgggggtaccccccggttaccggggtacccccgaacggggcccgtaacggggttaccccgggcccggttaccccggggtccccccccttaggggtccccgttccggggtcccttacggggtcccgggtttaccgggggttcccggttccgggtaccccgttacggggttcccgggttaccccggacccccgttacggttcccgggtccccgtttcgggcccccgtttccgggacccccggtaaccccggtttaacgggtttaccgggttacccggtaccccggaaacccgggaaacccgggttaaaccccgggggacccccgggggtaaaccccccgtaccgggtaaccccccggtacgggtaaccccggttccccgttaaggggttaaacccggggttaacggggtaaacccgggtccccggtaacccgggtaacccccggttaacccggttacccccggtaacccgggtaccccggggtttaacccggggaacccggggttaccgggtaaacccccggggtttggggggttaacccgggggtacccccggttaacgggggtacccccggaaacccccggggttaacccccggaaacccgggttaaccccccccgtaacccccgggttaacccttaccccggggttaaacccctccccggtttaccccccgggtttacccccccgg

SEQ ID NO: 18472 - DNA, 763 bp, Homo sapiens
  misc_feature: GYAE6OF01BQHTF.14.70.G04.1.454.CMB.1.raw
  modified_base (193)..(193): a, c, t, g, unknown or other
  misc_feature (193)..(193): n is a, c, g, or t
tcagcgtctagtaccacgaccggtgctcgatttagtgtagtgtgaagggaaaggggagggcagttggtagatgcccctctgggagagatccccgaggggtcgacagccatggaccctggaagggcctgggctagggacagggaccagagccagtccgaagggagaggacagacgaccaagtggacgtggggtntacgtgtaacagccctgcgtgggcgagacgggaccgagggccaccgtccgtccgagggacgcccagtgctcgacaaggtccgggccaggacggtcgccccgtagaaccgtggaacgccaaagtcggaacgacccaagacgaacggaccgtaaggtgggttcggtaggaaccggtaccccgtagggacggacggtcggtccggggtcccgttcgggacccgtacgggccgaacggtccggtccgtccgggtcccccgtggtccgtcgggtcgtcgggtcgtttcggggtccgttacgggacctacggttcgggtcccgacccgtaggtcggcccgttggaccgtcgcccgaccgttaggttcggtccgacgaccggaacggtaacggaccgggtacccacggtacccgtggacgtccgtacgtacgtacggacgacgacgtaccgtactccggacgtacggcggcgtaccggtcggtacgggtcgggacgtacgggtcccgacgggtacccccaaacgggtaccccctaacccgtaccgttacggtccctaccgttcccggttaccccccg

SEQ ID NO: 18473 - DNA, 641 bp, Homo sapiens
  misc_feature: GYAE6OF01DFYK3.14.70.G04.1.454.CMB.1.raw
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
tcagcgtctagtaccacgaccggtgctcgatttagtgtagtgtgaagggaaaggggagggcagttggtagatgcccctctgggagagatccccgagggggtgacagccatggaccctggaagggcctgggctagggacagggaccagagccagtccagggagaggacagagccaatggacgtggggtgtactgtaacagcctgctggacgaggacgggacgagggccaccgtcctccgagggacgcccatgctgcaagtcggccagaggtcncccctgaacctgaaggccaatgagaaccaagacagacaagtggtngacgacctgaggngcgtcgggccctggtcccgaggacagcgcgtcgcccctgctgctgcgtggctggcngtaggtccnccgtatcggctgcncggtccgaccgtaacgtcggtcgacgaaacccgacggaaaccgggtccggggaaaccccacggtaccccgtggtaaccgcccttaggacggttacggaacgaccgacggtccacgtccaacgtcccggtacggaccgggtacgccgttgggcgggaccgaaggtacccgcggaaccccgaaacggtacccccaaaccccgactacggtaacccctccgttccgtacccccgg

SEQ ID NO: 18474 - DNA, 720 bp, Homo sapiens
  misc_feature: GYAE6OF01B38WV.14.70.G04.1.454.CMB.1.raw
  modified_base (186)..(186): a, c, t, g, unknown or other
  misc_feature (186)..(186): n is a, c, g, or t
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtntactgtaacagccctgctggcgaggacgggaccagggccaccgtcctccgacgggacncccatcgctgcgaacggtcgggccaggacggtcgcccctagaacctggaacgccaatgaacgaccaagacaggcaaggtggtgngacgaccctgacggacgcgtcgggcctcggtcccacggcacgccgctccggccccgtgcctcgctcggtccgtgggtcctcggtaccgtacgtccgggtccgtcccgtacgtcggtccgtcgtccgtccggccgtacccgtaagttcgggttaccgacccgtaaccggaccggtaaaccgggccggggtaccccgaaccgggtacccgtcgggtaaccgtcccgtacgtacgggttaccgggaagcccggtacggacccgtaacgttcccgaacggtcccgtacggccggtaacggtcccgtacggggcgggtacgaccgggttacgacccggccccggaaacggacccccgtaacccctacgtaccgtaccctaccgttcccgttaccccg

SEQ ID NO: 18475 - DNA, 725 bp, Homo sapiens
  misc_feature: GYAE6OF01DDG6E.14.70.G04.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
tcagcgtctagtaccacgaccggtgctcgatttagtgtagtgtgaagggaaaggggagggcagttggtagatcgcccctctggggagagactccccgaggggtgacagccatggaccctggaagggcctggctagggacagggaccagagccaggtccgagggagaggacagagaccaagtggacgtggggtntactgtaacagccctgacgtggacggaggagggaccgagggccaccgtcctacgagggacncccagtcgactgactaacggtccgggccaggaggtccgccccgtagaacccgtggaaacggccaagtacggaaccgaaccaagacacggacgtaaggtcggttgacgaccggtacccgtaggacggacggtcgtcgggtccccgtagggtacccaggacgcgccgcgtccgcccgtgcgtacggtntcggngttcgggtacncggtaccgaggtttccgcccggtaccctaggttcgtcccgtcggtcggtaccgacccgttccgtaaggtcggttacaccgaaccggaccgaccgggaccggacccgaacggcccggtaacggtcgtacccgtagtaggtaaccggtagaccgaaggtccgaaccgtccgacgtccgacggacgtccggcggtcgggtacgggaccgacgtccggaaacccgacccgaacccgaccctacccgactcccggtactccctcggttcccccg

SEQ ID NO: 18476 - DNA, 754 bp, Homo sapiens
  misc_feature: GYAE6OF01DF8UL.14.70.G04.1.454.CMB.1.raw
  modified_base (186)..(186): a, c, t, g, unknown or other
  misc_feature (186)..(186): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtntactgtaacacgccctgcgtggcgaggacgggaccgagggcaccgtcctccgagggacgcccatgctgcgaaggtcggccaggaggtcgaccccgttagaaccgtagaacggccaaagtcggaaccgaacccgaagaaccgagaccgtaaggtgggttgtacgacgacccgtaggaggacgtccgtacgggccctacggtcccgaggcgacggcgccgtcggccctgctcgtcgtcggcgtacgggtccgtcggcgtacgtccgggtccgtacccgagttccggtccgtcggcccgtcggtacccgtccgtaacgttcgggttccgaccggaaccggaacggaacccgggccggggtaaccccgacggtacccggacgggtaccgtaccgtacggtaacggttacggaacgccgaccggtacccgaccgtaccgacgggtaccgtacggaccggacggtccggtcggggtaccggggacgtacgggtacccggacccggaaccccggtaacccgacccccgtaaacccgtacccgtaccgtcccgttaacccgtcccgttaccccccg

SEQ ID NO: 18477 - DNA, 1059 bp, Homo sapiens
  misc_feature: GYAE6OF01CG98T.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccgagggagaggacagagccaatggacgtggggtgtacgtgtaacacgccctgcgtgggcgaggacggggaccagggccaccgtcccgtaccgagggacgtccccgagtcgaccgttcggaccgtaacggtccgggacccgagggtacgggtcccgaccccgtacggaaccgtaacggaacgaccctaaagtacgaaccggaacccgaagaccgacgggaccgtaagggttgggttcggacggaccggtaccccgtagggaacgggtacgaccggtccgggcccgttaccgggtaccccgtagggacccgacgggccgtcccggtccggccccgtcggtccgtacggtccgttcgggtccggtcgggttcccgggtacggtacccggttacggttacccgggtccccggtaccccggtcggtcccgggtccttacggtcccgtacccggtacccccggtaccccggttaagggttcccgggttaaccccggtccccggtaaaacccgggaacccggtaaaccccgggggaaaccccccggggaaccccgttaacccgggtaacccccgggtacgggttacccgtaaccccggtttccggaaacgggggtttaacccggaaacccggtcccgggtaaccccgggtaccccgttaaacccggtaccccggtacccggggtttcccggggaacccggtacccggggttaccccggtacgggggttttaaccggggggccccgggggttaaaacgttcccgggggtaacccccccggtaaacccccgggaaaccccccggggtttaacccccccggaaacccccccggtaaacccccggggttaccttacccccccgggtttaacccggtttacccccccggtttcccccggtttttaaccccccccggggg

SEQ ID NO: 18478 - DNA, 711 bp, Homo sapiens
  misc_feature: GYAE6OF01CUYL3.14.70.G04.1.454.CMB.1.raw
  modified_base (238)..(238): a, c, t, g, unknown or other
  misc_feature (238)..(238): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccaggaggtcgcccctagaaccctgaaggccaatgagacccaagacaggaccaagtgggttgtgacgacccctgacggngactgggcctggtcccnggcagccgctcggcccagctgctgctggatctggcctagtcggtccgcccgagtcgggcctgctacggcgcccgtaagtcggttacgaccgaccgacgaaacggcccggggtacccgacggacccgtacgggaccgacccttacggaacggtttacgggaacggaccgacgggacccggtaacgttacccgacgggtaccccgttacgggcccgggtaacggtccccgggtttaggggtccgggggggtaacccgtacgggggtcccggtaacccgggaacccccggtaacccggggtaacccccctaaacccccggtacccggttacccggtaccccgtaaacccgtttccccccggg

SEQ ID NO: 18479 - DNA, 593 bp, Homo sapiens
  misc_feature: GYAE6OF01A66EP.14.70.G04.1.454.CMB.1.raw
  modified_base (288)..(288): a, c, t, g, unknown or other
  misc_feature (288)..(288): n is a, c, g, or t
  modified_base (391)..(391): a, c, t, g, unknown or other
  misc_feature (391)..(391): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggagcccatgctgcaagtcgggccagaggtgcccctgaacctgaagccaatganaccaagacaggccaagtggtagtgagccctgaggagctgggccctggtcccaggccagcgcgtcggcccctgcgtcgctgcgtcgggactggccatcgggtcncccgagtcgcgtgctcgcgtccaatggtacgcaccgacgaacggccgggacccagaccctggcactcgagtcgaacgcaggccgatccgagccgtcggaccggagtcccgtagggtccggggacgtacgggtaccgtacggaccccgtaaaccgggacccctaaccccgaacgtcccggtacccacccgttccgttaccccg

SEQ ID NO: 18480 - DNA, 773 bp, Homo sapiens
  misc_feature: GYAE6OF01BVNYW.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacnccatgctgacaacggtcgggccaggacggtcgcccctagaacctggaacgccaatagaacgaacccaagaccgacggaccgaacggttgggtgtacggacgaccccgtaggacggacgcggtcgggcccgtgggtacccgaggcagccgcgtccggccctgcgtgcgtcgcgtcggtctcggcgtacgtcggtaccgcccgtacgtcggaccttcggtccgtccgacccgtacctacggttcggtacgtaccggaacccgtaaccggaaccggggacccggggaacccgtaccgtaccccggtacgggacccgtaccgtaccggtacggttaaccgggaaccgtaccggtacgtacccgggactaccccgtaccgggtacccggttccgggaacccgggtaccggttccggtaccgggggttacgggggtcccgtaacgggtcccggaaaccgggaccccgtaaacccggaaccccccgtaaccccgtaccgttacccggtaccccttaacccgtcccggtttaccccccggg

SEQ ID NO: 18481 - DNA, 719 bp, Homo sapiens
  misc_feature: GYAE6OF01B2LQH.14.70.G04.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
tcagcgtctagtaccacgaccggtgctcgatttagtgtagtgtgaagggaaaggggagggcagttggtagatgcccctcgtgggagagactccccgaggggtgacagccatcggaccctgggaagggcctgggctagggacagggaccagagccagtccgagggagaggacagacgccaagtggacgtggggtntactgtaacncgccctgcgtggcgaggacgggaccgagggccacccgtcctccgagggacncccatcgctgaccgaaggtccgggccaggacggtccgccccgtagaacccgtagaaccggaccaagtacggaaccgaacccgaaagaccgacggaccgtaaggtcggggttgtacggaccggtaccccggtaggacggacggtccggtaccggggtccccgttacgggtccccgagggccgacggcccgtccgtccggtccccgtgccgtcgcgtcggtcgtcgggtaccgtcgacgtcgtcgtcgcccgtgtccggctcgcgtccgccgccgtagtcgtcgaccgtacgacggaaccggccggaccaccggtaccgcgacgtccgtcgtacggtacgacgcgaccgtcgtaccgcgacgccggcggaccggccggtccggtacgggttacgggcggtaccggaccggacccgacccgaacccgaccccgaaccctcgtaaccctccacccgttcccgtccccg

SEQ ID NO: 18482 - DNA, 920 bp, Homo sapiens
  misc_feature: GYAE6OF01CCENG.14.70.G04.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaagtggacgtggggtgtacgtgtaaacgngccctgcgtggcgaggacgggaccagggccaccgtcctccgagggacncccgagtcgcgtcgacgtaacggtccggaccgacggtacggtccggccccctaggaacccgttggaacggaccaacgtacggaaccgaacccgaagacgacggtaccgtaaggtggggttagtacgccgtacccggtggacggtacggcggtaccgggcccgtacggtcccgaagggccgaccggccgtccggtccggtacccgtcggtccgtaggtcccgtggtaccggttcggtccgtcggtccgtcgggttaccggcccgtacccggtcggttccggtcccggttgacccgtccggaccccgtaaccggtgggttcccggtaaccgacccggacccggaaacggtacccggggaacccggtaaccccgaacccggtacccggtaccgggtaccccgacggggtttaacccgtaagggtacccgggaacgtcccggtaaacgggtccccgttaaacccgcccgaacgggtcccggttaaacccggggaccggtcccgggttccggtcggggggtaaccggaaccccgggtttaccgaaccccgggggaacccccgtaaccccccggggttaaaaacccggaccccccccgggttaaaccgtaccccggggttaacccccgttacccggttaaaccccccgtttttccccgggtttaccccccccccggg

SEQ ID NO: 18483 - DNA, 877 bp, Homo sapiens
  misc_feature: GYAE6OF01CSVT5.14.70.G04.1.454.CMB.1.raw
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagtcagtccagggagaggacagagccaatggactggggtgtactgtaacagcctgctggcgagagggaccagggcaccgtcctccgagggagcccattcgctggcgaacggtccgggaccaggtacggtcgccccctagaacccgtgaaacggaccaagttcggaaccgaacccaaaagacgaacggacctaagggtggggtttacggtacggaccgtaacccccgtgggaacggacgtaccggtcggggtaccccgttcgggtacccccgaggggacccgacggccgtcccggttacggccccccgttaggtccctacggtccgtacggtccggttcgggttccggtaccggtacccttggtaccgggtccccgaccccgttgggtccggtcccgttcgtccgggtccgtacccggtacccctaaacggttcggtaacgtacccgaacccggaaccgggaaacccgggtaccccggggaacccccgtaaccggtacccccggtacgggtaacccggccgtttaacggtacgggttaacggtaaccgacccggtaacggtacccgtaccggttaccgtaacccgggtccgtacggtacccgggtacgggtcccggtggggtacccggggttcggaacgggtacccggtaaaccggcccccgggtaaaaccgtacccccgtaaacccccgtaccgttacccgttccctaaccccggttccgtttaccccccggg

SEQ ID NO: 18484 - DNA, 805 bp, Homo sapiens
  misc_feature: GYAE6OF01DV571.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggacgcccatcgctggccaacgggtcgggaccaggacggtcgccccgtagaaccgtgaaacggccaaatcggaacgaacccaaaggaacgacggaccgaaggttggggttgtacggacggtacccccgtagggcgggaacggtccgttcgggggcccctcgggtaccccgagggccaggccgcgtcggccccgtgctcggtctcggtcgttcgggtctacggccgagttccgggtccgacccgtaggtcggtcccgtcgtccgtcggtcccgtaccgtacgttcggttaccgaccgtaaccggaaccgaaaccgggacccgggggtaaaccccgaacccgggtaccccggttacgggcccgtaccgttaccgggtaacggttacgggaaccggtaccgaaccgggtacccgtaaccgtccccgacggtaccggtccggaccgggtccggacccgggttagggtccggggggccgttacggggtaccggtacccggaaaccccggaaacccgggtacccccaaaccccggtacccgtaccggttaccccgtacccttcccggttaaccccccg

SEQ ID NO: 18485 - DNA, 695 bp, Homo sapiens
  misc_feature: GYAE6OF01CFVWV.14.70.G04.1.454.CMB.1.raw
  modified_base (625)..(625): a, c, t, g, unknown or other
  misc_feature (625)..(625): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaatggactggggtgtactgtaacagccctgctggcgagaggaccagggcaccgtcctccgagggacgcccatgctgcgaagtcggccagaggtcgcccctgaaccgtgaacggaccaagtacgaacgaacccaagaacgacggaccgtaaggtgggtgtacgacgaccccgtaggacggacggcgtcgggtcccgtcggtccccgagggccgacggccggtccgtccggccccgtcgccgtcggccgtcgggtcgttcgggtccgtcggtccgtacggttccgggtaccggcccgtaggtccggtccgtcggtacgtccggccgtacccgtaagttcggtcgacccgtaccgaacggaaaccgggcccgggaacccgaaccgtcccggacggaccgtccgtacgtacgggttacgaacgcacggtccacgtccgcgtccgcggcgcgcggtcggngggtccgaggtccgaccgacccgaacgtaccccgaacccgtcgtaccgtcccgtcgttcccggttccccg

SEQ ID NO: 18486 - DNA, 692 bp, Homo sapiens
  misc_feature: GYAE6OF01DC7BQ.14.70.G04.1.454.CMB.1.raw
  modified_base (359)..(359): a, c, t, g, unknown or other
  misc_feature (359)..(359): n is a, c, g, or t
  modified_base (575)..(575): a, c, t, g, unknown or other
  misc_feature (575)..(575): n is a, c, g, or t
tcagcgtctagtaccacgaccggtgctcgatttagtgtagtgtgaagggaaaggggagggcagttggtagatgcccctctggggagagatccccaggggtgaccagccatggaccctggaagggcctgggctagggacagggaccagagccagtccagggagaggacagacgccaagtggacgtggggtgtactgtaaccagccctgcgtggcggaggacgggaccagggccacccggtccgtccgagggccgcccagtcgctgacgacggtccgggcaggacggccgcccctagaaccgtgaacgccgaatacgacgaacccgaagacgacgacgtaggtaggtgacgaccgtcccgnggacggacgtcggtccggccgtcgggtaccaggcgacgcgacgtccgccgtcgcctgcgtcggtcgtacgggtcctcggtccgtaggtccgccggtcctagtccggcctggccgcggtccgtacgtacgttcggtcgaccgtaccggaacggtaaccggcccggtacccgacgaccgtacgaaccgtccgagtacggtagccacggactaccgganacccgtacgtccgcgggtccgccggtacggtggggtacggcggtacccggacaccggtaaccccggacccgtaccccgaacccgttccgtacgtacccggttcctcccggttcccgg

SEQ ID NO: 18487 - DNA, 752 bp, Homo sapiens
  misc_feature: GYAE6OF01EE83R.14.70.G04.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (416)..(416): a, c, t, g, unknown or other
  misc_feature (416)..(416): n is a, c, g, or t
  modified_base (453)..(453): a, c, t, g, unknown or other
  misc_feature (453)..(453): n is a, c, g, or t
tcagcgtctagtaccacgaccggtgctcgatttagtgtagtgtgaaggggaaaggggagggcagttggtagatgcccctctgggagagatccccgaggggtgacagccatggaccctgggaagggcctgggctagggacagggaccagagccagtccaggggagaggacagagccaatggactggggtntactgtaacngccctgctggcgaggagggaccagggcaccgtccacgaggacgcccatgctgcaacggtcggcaggaggtcncccctagaacctggaaacggccaatcgaacggaacccaagacgacggacgtaaagggtggggtttagacggaccgtacccggtagggacgggacggtccgtcggggcccgttcggtaccccgagggctacggcgtccgccggccncgcgtcgctgcgtgggtactcgacctaggtcggaccnccgtgtcggtccgtcacgtccggacctccgtaaggttccgtacgggccaaccgggaccggaaaccgggcccggtaacccaccggtacccgtcggaacgtcccgtaggttacggtaaggaccggtacccgtacgggcccttacggaccccgttagcccggtacgggaccgggttaccgccgggggttacggtaccggggggaccgtacggggtaaccccgaacgggacccccggtaacccggaaccccccgtaaaccccgtacccggttacgaccccgttccgttcccggttaccccccg

SEQ ID NO: 18488 - DNA, 714 bp, Homo sapiens
  misc_feature: GYAE6OF01B34JW.14.70.G04.1.454.CMB.1.raw
  modified_base (368)..(368): a, c, t, g, unknown or other
  misc_feature (368)..(368): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaatggacgtggggtgtactgtaacacgccctgcgtggcgaggagggaccgagggccaccgtccgtccgaagggacgacccagtcgctgacgaacggtccgggccgaggacggtcgccccgtagtaaccgtgaacggaccaaagtcgaacggaacccaagacgaaggaccgtaaggtgggttcgtgacgtaccccgnggacggagcgtcggccgtcggccaggcgacgcgcgtcggccctgcgtcgctcgcggtaggtctcgctacgtcggccgcctacggtcgtccgcgtcgtcgacccgtccgagttcccggtacgtcccgaaccgaacggaaccgggcccggggtaacccgaaccgggtacccggtaccggacccgtcgtaaccggttagggtaacggaaccgtccgaacgacccggtaacctacggcgtaccgtacgggccgtaccggtcgtaccgggtcgggcggaaccgtcggaacccggacccgacccggaaccccgtaccctaaccggtctcccgtacgttcccgttacccccgg

SEQ ID NO: 18489 - DNA, 625 bp, Homo sapiens
  misc_feature: GYAE6OF01DU8H6.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaagtccgggccagacggtgcccctgaacctggaacggccaaatcgaacgaacccaagacacggccaaggtgggttgtgacgacccgtgacggagcgtgggccctggccccaggcagcgctcggccctgctgctgctggtctggcctagtcggtcgcccatcggcctgcctcgccgtccctaagtcggttgccaccgacgaaacgggtccgggaacccacgtacccgtcggacgcccgttacgcggttacggaacgcgacgggtccgactaccgacgtccgtacggccggacgggtccgtgggtcggggactacgggtccgacgacccccgaacgtccccaaaccccgtactacgtaccctcgttcccgttaccccg

SEQ ID NO: 18490 - DNA, 857 bp, Homo sapiens
  misc_feature: GYAE6OF01A54HU.14.70.G04.1.454.CMB.1.raw
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccgagggagaggacagagccaatggacgtggggtntactgtaacncgccctgctggcgaggacgggaccgagggccaccgtcctcgagggacncccgatcgctgcgaaggtccgggaccagggacggtccgaccccgtacggaaacccgtaggaaaccggaccaaacgtacggaaacggaaacccccaaaggaaccgaacgggacccgtaaagggtttcggggttaggtacggaccggtaccccgtagggacgggacgtccggtaccggggtcccgttcggtccccgagggccacgggtcccggccggtccggccccgttgccgtcggtcgttcgggtccggttggggtacccgttcggacccgtacggttccgggtttacccgccccggtacgttccggggtcccgtcgtcccgggtcccggcccgtaccggttaacggttcggttacccgacccggaacccgtaccgggaacccggggtacccgggaacccgtacccgggacccggtacgggacccgttacccggtacccgttggtaaccgggtaacgacccggacggttacccgtacgtcccgaccggtaccgggtcggtcccgggtacggtccggcgggggttccgggtacggacccggtacggccccggaacccgaacccggacccccgaacggtacccttacggtcctaccccgttccgtacccccgg

SEQ ID NO: 18491 - DNA, 774 bp, Homo sapiens
  misc_feature: GYAE6OF01BHJXW.14.70.G04.1.454.CMB.1.raw
  modified_base (187)..(187): a, c, t, g, unknown or other
  misc_feature (187)..(187): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagcgtctagtaccacgaccggtgctcgatttagtgtagtgtgaagggaaagggggagggcagttggtagatgcccctctgggagagatccccaggggtgacagccatggaccctggaagggcctgggctagggacagggaccagagccagtccaggggagaggacagagccaatggactggggtntactgtaacacgccctgctggcgaggagggaccagggccacccgtcctaccgagggacncccancgctgacaacgggtccgggccaggacggtccgccccgtagaaccgtggaacggtccaagtacggaacgaacccaaagaacgacggaccgaaggttgggttggtaggaccgacccgtggaggacgtcggtcgggtccctccgggtcccaggccgacggtccgtccggtcccggccctcggccgtgtccgtggccggttggggtccgttcgggtccggtacgttccgggtcccggacccgtacggtcgggcccgtcggcccgttccggcctaccccggtagttcgggttaccgacccggtaccgaccggaacccgggacccgggaaccccggaccggtaccccggtacggtacccggtccgtacgggtacggtacgaccggaccggaccgtccgacccgttaccgcgccgggtaggtacccggacggttcccggaggggtcgggaccggtcggtaccgacccggacccgaccccggtaacccgaccccgtaccgtccgttaccccgtcgttccccgttacccccg

SEQ ID NO: 18492 - DNA, 776 bp, Homo sapiens
  misc_feature: GYAE6OF01CX1DV.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaaggcctggctagggacagggaccagagccagtccgagggagaggacagacgccaagtggacgtggggtagtacgtgtaacacgccctgctggcgaggacgggaccgagggccacccgtcctacgagggacgcccatcgctggacgaacggtccgggcaggacggtccgccccgtagaaccgtaggaacgactaagacgaaccgaaccgaacgacgacggacgtaggtggtcggtacgaccgtaccgtaggacggcggtccggtcggtcccgtccggtaccgacggacgacggccgtccgtccggcccgtgtccgtcggtcgtcggtccggttcggtcggtcgtaccggtacggtcggtacccgtaccgtacggtcggtaccgtcggtccgtccggaccgtacgtacggtaccggtaccgaccgtaccggaacgggaacccgggacccgggaacccgacccggtaccggtacggtaccgtaccgtacggtaacggtacgacggtaccgaccgtaccgaccgtccggtaccgccggtacggaccggtccggtaccgggtacgggccgggtaccggaaccggtaccggaacccggacccgaaccccggtaccccgtaaccccgtacggttaccctacccgttccgttccccggttaccccg

SEQ ID NO: 18493 - DNA, 731 bp, Homo sapiens
  misc_feature: GYAE6OF01CB251.14.70.G04.1.454.CMB.1.raw
  modified_base (300)..(300): a, c, t, g, unknown or other
  misc_feature (300)..(300): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccagggagaggacagagccaatggacgtggggtgtactgtaacagccctgcgtggcgagacgggaccagggcaccgtcctccaggggacgcccatgcctgacgaagtcgggccaagacggtcgcccctagaacctggaacgcctaaagngaacgaacccgaagaccgaaggccgaaaggtgggttgtcggacgacccgtggacggagccgtcgggccctcggtcccaggcacgcgtcgcggccctgctcggctcggtcgtcgggtaccgtcgacctggtcggtcccggccacgtcggccctcggccgcggtacgtacccgtacggtcggttacggacccgtaccggaaccgaacggggacccgggtaaccccgaaccggacccgggtacggaccgtcccttaacgggtacggttacgggaacggcccggtaaacggcccgtacgaccgtacgggtccccgtacggcggggtaaccgtccggtagggggtccgggacggtccggtaccggaaccgggacccgaaacccggacccccgttaacccgacggttaacccgccgaccggtttccccgtcccccgg

SEQ ID NO: 18494 - DNA, 862 bp, Homo sapiens
  misc_feature: GYAE6OF01BCP8Z.14.70.G04.1.454.CMB.1.raw
  modified_base (188)..(188): a, c, t, g, unknown or other
  misc_feature (188)..(188): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaagtggacgtggggtntactgtaacacgccctgctggcgaggacgggaccagggccacccgtcctccgagggacgcccatggctcgacgaacggtccgggccgagggaggtccgaccccgtagtaaccgtaggaacggaccgaaagtcggaaccgaacccgaaacggaccgtaacggacccgtaaaggggttcgggttaggacggaccggtaccccgttaggaacgggacggtccggttccggggccccgttacgggtaccccgacgggaccgtacggccggtccggtaccggtccccctgccggtcgtcgttacggccggtcgggtccgtcggaccgtacggtcggtacccgccgtcgtccgggcctcggtcgtccgaccgtaccgttaaggtcggtaccgacgtaaacccggacggaacccggggtaccccggggaaccaccggttaaccccgggcggtaccggtaccccgtaaccgggtttaggtaacccggaagtaccccggaaccggtacccgttaacccgtcccgtaacgcccggtacgggaccgggtcccggtacggggtccggggaacgggttccggaacccgggtaccggtaaacccggacccccggtaaaccccggttaccccccgaaacccgttacccggttacccgtaacccgttccccggttcccgttaaccccccg

SEQ ID NO: 18495 - DNA, 584 bp, Homo sapiens
  misc_feature: GYAE6OF01AWNC1.14.70.G04.1.454.CMB.1.raw
  modified_base (262)..(262): a, c, t, g, unknown or other
  misc_feature (262)..(262): n is a, c, g, or t
  modified_base (467)..(467): a, c, t, g, unknown or other
  misc_feature (467)..(467): n is a, c, g, or t
  modified_base (529)..(529): a, c, t, g, unknown or other
  misc_feature (529)..(529): n is a, c, g, or t
tcagcgtctagtaccacgaccggtgctcgatttagtgtagtgtgaagggaaagggaggcagttggtagatgcccctctgggagagatccccagggtgacagccatggaccctggaagggcctgggctagggacagggaccagagccagtccagggagaggacagagccaaatggactggggtgtactgtaacagccctgctggcgagagggaccagagcaccgtctccagggagcccatgctgcaagtcgggccagacggtncccctgaacctgaaggccaatgagaccaagacaggccaaagtcgggttgtgaacgaccctgaggagcgtgggccctggtcccgaggcaggcgctcggcccctgctgcgtgctggtctaggccagtcggtcgcccattcgggcctgctagccgtacccaagtcggttcgctaccgacgaaacggccgggacccaggaccctggacnccgtcgacgttacggaacgcgagtccgactccgagccgtcggcggacgtccgtgggtcgggntacggtcaccgtacccgaaccggtacccaaccccgagtcgtccgtaacgttcccg

SEQ ID NO: 18496 - DNA, 721 bp, Homo sapiens
  misc_feature: GYAE6OF01C3Z49.14.70.G04.1.454.CMB.1.raw
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggactggggtgtactgtaacagccctgctggcgagaggaccagggccaccgtcctccgagggacgcccatgctgcaaggtcgggccaggacggtcgcccccgtgaacctggaaacggccaagtcgaacgaacccaaagaccgaaggaccgaaaggtgggttgtacggaccgacccgtgagggacgcgtcgggccctcggtcccgaggcacgccgcgtcggccctgctgctgcgtggtcncggcngtcggtccgccacgtcgctgctcgccgtaccagtcggtcgccgaacccggcgaaaccgggccgggaaccccacggtacccgtacgggtaccgtacccgttacggtacgggttacggaaccgtacccggtaacggacccgtaacgtaccccggaacggtcccgtacgggacccgggtacggtcccggtggggttacgggggaccgtaacggggttcccgaacccgggaacccccggaaaccgggtacccccgtaaaccccgtacgttacccgtaaccccgtcccgtttcccgttaccccccgg

SEQ ID NO: 18497 - DNA, 859 bp, Homo sapiens
  misc_feature: GYAE6OF01CJKT1.14.70.G04.1.454.CMB.1.raw
tcagcgtctagtaccacgaccggtgctcgatttagtgtagtgtgaagggaaaggggagggcagttggtagatgcccctctgggagagatccccgagggtgacagccatggaccctggaagggccgtggctagggacagggaccagagccagtccgagggagaggacagacgccaagtggacgtggggtgtactgtaacacgccctgcgtggcgaggacgggaccgagggccaccgtcctccgaggacgcccagtcgctgacgaacggtcggccaggacggtcgaccccgtaggaaccgtggaacggacctaagtacggaaccgaacccgaaacgaccgacgggaaccgtaacgggttggggttacgtacggtaccgtaccccggtggaacggggaccggtccggtaccgggggtccccggtccgggtaccccgacgggccgacggtccggcccgttccggacccccgttgcccgtcggtaccgttcggtccggtcggggttaccgtcgggtacccgttacgggttcccgggtaccccgtacccgtcggttcccgggtaccccgtcggcccggtcccggtcccgtaaccgttacggttcgggttaccgacccgaaccgggtacggaaaccccggggtacccgggtaacccgaacccggtacccggtacggtacccgtaccggttaccgtaacggttacggaacggtccggacccgggtaccgtacccgacgtacccggtcggtaccggccggccgttccgggtacgggttaccgggaccggtacgggacccgaccccggaccggtaacccccggaacccaccccgttactcccggtaccctccgttcccgttaccccccg

SEQ ID NO: 18498 - DNA, 844 bp, Homo sapiens
  misc_feature: GYAE6OF01A54NM.14.70.G04.1.454.CMB.1.raw
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtccgggccaggacggtcgccccctagaaccgtggaaacggccaaagtcgaagaacccaagacgaggaccaaggtgggttgaggacgacccgtggaggacggcgtcgggcccgtggtacccgaggcctacggccgtccgtccgggtccccctggcccgtcggccgtcggtccgtcggggttccgtcgggtccctaggttccgggttaccgcccccgtaggtccgggtcccttggcccgttccgggccgtaccccgtaagttcgggttaccggccgtaacccggaaccggaaacccgggtccccgggggaaacccctaaccgggtacccggtaaccgggacgtaccccggttacggtaacgggttacgggaacgacccggaaccgggtacccggtacctaccccggaacccggtcccgtccggggtcccggtaacccgggtccccgggttacgggggtccgggggtaacccgggtaccggggttacccccggaaaccggtaaccccccgggaaacccggggacccccccctaaaaccccggttaaccggtaccccgggttacccccttcccggtttaaccccgtttccccccggg

SEQ ID NO: 18499 - DNA, 838 bp, Homo sapiens
  misc_feature: GYAE6OF01CTS30.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccgagggagaggacagagccaatggactggggtntactgtaacagcctgctggcgagaggaccaggcaccgtcctcgaggacgcccatgctgcaagtcggccagaggcgcccgtagaacctgaacggccaagtcgacgaacccaaagacgaaggacctaaggtggggttgttacggaacgaccccgtggaacggagaccggtcggggtacccgttcgggtaccccgagggaccaggaccggccgttaccgggcccccgtcggtccgtcgccgttcggtacgtcggggttccgtcgggtaccctcggttcgggtaccccggcccgtaacggttccggccgtcgtaaccggttccggacccgtaccccgtaaaggttccgggtttcgacccgaaacccggttaccgggaaaaccggggcccggggtaaacccccggaacggtaaccccggtacgggaacccggttaccccgtaacggtttaccggggttaacggaaccggtccggtaaccgggtaccccggtaaccgttaccgtaacccgggtccgtaccggggccggtaacggttccccgggtaggggttaccgggggaccgtaacggggtacccgacccggtaaccccggaaaccgtccccccggaaaccccgttaccggtccgtaacccgttccgttccggtttaacccccccggg

SEQ ID NO: 18500 - DNA, 809 bp, Homo sapiens
  misc_feature: GYAE6OF01E4XOJ.14.70.G04.1.454.CMB.1.raw
  modified_base (253)..(253): a, c, t, g, unknown or other
  misc_feature (253)..(253): n is a, c, g, or t
tcagcgtctagtaccacgaccggtgctcgatttagtgtagtgtgaagggaaagggagggcagttggtagatgcccctctgggagagatccccgaggggtgacagccatggaccctggaaggcctgggctagggacagggaccagagccagtccgagggagaggacaggagaccaagtggacgtggggtagtactgtaacacgccctgcgtggcgagaggaccagggcaccgtccacgaggcgaccagtcgcgngcgaaggccgggacgaggacggtccgaccccgtagtaaccgtacggaaccggacgaacgtacgaaccggaacccgaaaggacgaacggaccggtaaggttcggggttagaccggtaccgaaccccgtgggacggtacggtccgggtcccgggcccgtccgggtacccgaggaccggtacggcccggtccggtacccggtcccgtccgttcgtaccggtcgtccggtcggttccgggtacggtccggtacccgttcggtaccggtccccggccgtacgtcccgggccgttccggccggtcccggccgtaacccgtacgggtacggtaccacccgggtaacgaacccgggaacccgggtacccgggaaccccgtaccgtacccggtccggtaaccgttccgtaccggttaggtacggaccgacgaccggcgtaccgacgccggtaccgcggacgtccgggtcggtccgggacggtccgtagacccggccccgggaaccccgaacccggtaccctacccggttcgtaaccccgttctacccgttcccggttaccccccg

SEQ ID NO: 18501 - DNA, 779 bp, Homo sapiens
  misc_feature: GYAE6OF01BRTXX.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgaggacgggaccagggccaccgtcctccgagggacgcccatgctgcgaacggtccgggccaggaggtccgccccgtagaacctgaacggccaaagtcgaacgaacccaagacgacggaccgtaaggtgggttgtggacgaccccgtaggacggacgtccgtcgggcccgtcggtacccgacggcgacggccgtccgtccggcccgtgctcgcgtcggcgtcgggtctcggcctacgtccggtccgccgtacgtcggtccgtcgccgtccggacccgtaccgtaggttccggtaccggaccgtaacccgaacccgggaaccggggtacccggggaaccccgtaccgggtaccccggtacgggtacccgtacccggttacggtaacggttaccgggaaccgtaccggaccggtacccgaaccgtccccgtacggtacccggtcgggccggtaccgttccgggtacggggtacccgggcggtaccgggtacccgtaacccgggaccccggaaaccccggacccctaaccccggttacccgaccgttaccccgtccgtttaccccgttaacccccgg

SEQ ID NO: 18502 - DNA, 777 bp, Homo sapiens
  misc_feature: GYAE6OF01B7RK3.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacacgccctgcgtggcgaggacgggaccgagggccaccggtccctccgagggacgcccatgctgcgaacggtccgggaccaggacggtccgccccgtagaacccgtaggaacggaccaagtcggaacgaacccgaaagaccgacggaccgtaagggttcgggttgtacggaccggtacccgtggacggacggtcggtccggggtcccgtcgggtacccgaggtcgacggcggaccgtccggccccgtgccgtcgcgtcggtcgtcgggtcctcggacgtggtccggccgtacccgtacggtccggccgtcggtccgtccggaccgtaccgtaaggttccggtacggaccgtaaccggaccggaaaccgggcccggggaaaccccgtacggtacccggacgggtacccgtccggttagggtacgggttacggggacgtacccggacggacccgtaacgtcccggaggcccggtaggccggtaccggtcggtcggggacgggtccgtacggacccggtaccggaccccgaaacccggccccgaaacccgtcgttacccggaccctaccggttccccgttacccccg

SEQ ID NO: 18503 - DNA, 780 bp, Homo sapiens
  misc_feature: GYAE6OF01B88YY.14.70.G04.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggctgggctagggacagggaccagagccagtccagggagaggacagagccaagtggacgtggggtntacgtagtaacngccctgcgtggcgagagggaccgagggccaccgtccncgagggcgcccagtgctagcaacggtccgggacgaaggcggtcgccccgtagaaccgtaggaacgacctaagtacggaccgaaacccgaagaaccgacgggaccgtaaagggttcggggttacggtacggaacccggaccccggttagggaacgggacggtaccggtacccggggtccccgttcggggacccccggaagggcccggtaaccggccggtcccggtccggtcccccgtggcccgttcgccgtcggtacggtcggtccgtcggtacctcgggtccggcccgtaccgtcgtccggacccgttgcccgttcggacccgtaccggtagtcggtaccgaccggtaaccgacggaaccgggccggaacccgaccggtaccgcggtaccgcgtacgtaggtcgaaacgccacggtacgccgaccgtcgaccggtacggccggtacggccggtgggtaccggcggtaacgggtccacccgggttaaccccaaccgggaccccctaccggtaacctcggtacccttaccgttcgttcccccccgg

SEQ ID NO: 18504 - DNA, 794 bp, Homo sapiens
  misc_feature: GYAE6OF01CI7PZ.14.70.G04.1.454.CMB.1.raw
  modified_base (189)..(189): a, c, t, g, unknown or other
  misc_feature (189)..(189): n is a, c, g, or t
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
  modified_base (669)..(669): a, c, t, g, unknown or other
  misc_feature (669)..(669): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccgagggagaggacagacgccaatggacgtggggtntactgtaacagccctgcgtggcgagacgggaccaggccaccgtcctccggagggacncccagtcgctggacaacggtccgggaccagggaggtccgtaccccgtagaaccgtaggaaacggacccgaagtacgaacgaacccgaacgaccgacggacgaacggttggggttcggtacggaaccggaccccgtaggaacgggacggtccgggtccggggcccgttaccgggtccccgagggtaccncgggccgccggtcccggtcccgtcggcccgttgtccggtcggtccgggttacgggtccgtccggtaccgtacggtccggtcccggtaccgtcggtccggtccgtcggcccgtccggtacccggaccgttacggttccggtaccgacccggaaccggaaccgggaacccgggacccgggacccggaacccggtaccggtaccggtacccgtaccgtacgttacggttaccggaacnccggacggtaccgacgtacccgtcggtaccgcgggtaccggcggtacggtcgggacggtcggaccggtccggaacgaccccggaccgaacccgtacctcgtccctaacgtccgtcccgttccccg

SEQ ID NO: 18505 - DNA, 697 bp, Homo sapiens
  misc_feature: GYAE6OF01C0CLA.14.70.G04.1.454.CMB.1.raw
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
  modified_base (546)..(546): a, c, t, g, unknown or other
  misc_feature (546)..(546): n is a, c, g, or t
  modified_base (561)..(561): a, c, t, g, unknown or other
  misc_feature (561)..(561): n is a, c, g, or t
  modified_base (579)..(579): a, c, t, g, unknown or other
  misc_feature (579)..(579): n is a, c, g, or t
  modified_base (609)..(609): a, c, t, g, unknown or other
  misc_feature (609)..(609): n is a, c, g, or t
tcagcgtctagtaccacgaccggtgctcgatttagtgtagtgtgaagggaaaggggagggcagttggtagatcgcccctcgtgggagagactccccgaggggtgacagccatggacccgtgggaagggccgtgggctagggacgagggaccagagccagtccgagggagaggacagacgcaagtggacgtgggtgtactagtaacgagcccgtgcgtggcgaggacgggaccgagggcaccgtcctacgagggacgcccagtcgcagacgtaaggccgggaccaggtacggtcgaccctacgaacctaggaacgtacagngaacgaccgaagacgtacggaccgtaaggtcggttagcgaaccgtaccgtagaggacgcgtacggccctcggaccgagcgacgcggtctccgtcccngtctcgcgtgcgtgtcgacggtctacgtcgccgaccgtgtcgggaccttgctcggcccgacgtacggttcggtacgacgaacgaaaccggaacgggcccggtaaccgacggaccgtacggacgttacgngtacggtacggaacncggaaccgttggaacccnggtaccgcgtacggaccgcgggttaccggnggggtaccggaccgacgggtaacccgacggaaccccgtaaccccgaaccgtacccgtacgtaccgtaccctccgtacccgttaccccg

SEQ ID NO: 18506 - DNA, 736 bp, Homo sapiens
  misc_feature: GYAE6OF01AHF6G.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgcgtggcgagagggaccagggcaccgtcctccgagggacgcccagtgctgacgaacggtcgggccaggaggtccgcccctagaaccgtaggaacggaccaagtacgaaccgaacccgaacgacgacggaccgtaagggttcgggttaggtacggaaccgtacccgtaggacggacgtcggtccgggtcccggtcggtcccgacggacgacggccgccgtccggcccgtcgccgtcggtccgtcggtccggtcggtcgtcggaccgtacggtccggtcccgccgtacggtccggtcgtcgtccgtccggaccgtaccgtacgttcggtacccgcccgaaccggaaccggaaccgggacccgggaacccgaccggacccggtacggccgtcgtacggtacggtacggaacgccgtaccggtaccgtactccggacgccgcggaccggtccgtcgggtcgggacgggccgtacggaccgacccggaacccggaccgaccccgtaaccctacgtaccgtccttacccgtcccgtccccg

SEQ ID NO: 18507 - DNA, 751 bp, Homo sapiens
  misc_feature: GYAE6OF01ARTUW.14.70.G04.1.454.CMB.1.raw
  modified_base (241)..(241): a, c, t, g, unknown or other
  misc_feature (241)..(241): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggcaccgtcctccgaggggacncccatgctgcaagtcgggccaggaggtcgccctagaacctggaacgccaatgaacgaacccaagacgaggccgtaaggtggtggagtaccgacccgtggaggacgccgtgggccctcgggtcccagggccgacgcgggccgtccggtccccgtgccgttacggcctcggtccgttcggggtacctcgggaccgtacggtccgggttacccgccccgtaacgtccgggtccgttacggccgtccggacgtaccccggtaacggttcggtaccggtacccgaacccggtaacgtaaccgggacccgggtaaccctaccggtacccggtacggaccgtaccgtacggtaacggttggaaccgtcgacgtaccgacgtccgggaccgtacggtacggaccggcggtaccggttacggggtcgggaacccgtacgggacccgtaccggaccccgaacccggtaccccgtaaacccgttctaccccggacccttacccgtccccggttaaccccgg

SEQ ID NO: 18508 - DNA, 755 bp, Homo sapiens
  misc_feature: GYAE6OF01E4CRQ.14.70.G04.1.454.CMB.1.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (734)..(734): a, c, t, g, unknown or other
  misc_feature (734)..(734): n is a, c, g, or t
tcagcgtctagtaccacgaccggtgctcgatttagtgtagtgtgaagggaaaggggagggcagttggtagatcgcccctctgggagagactccccgagggggtgacgagccatcggaccctggaagggcctgggctagggacagggaccagagccagtccagggacgaggacagagccaagtggacgtggggtntactgtaacagccctgctggcgagacgggaccngggccaccggtccnccgagggactcccatcgctgacaaggtcggacagacggtcncccgtagacctgaacggccagtgtacgaccaagacacggaccaaggttggttgtacggacgtaccccgtagaggacgtaccgtcggggtaccctcgggtacccgaggcgacggccgcgtccggccctggctcggctcggcggtacggtccgcggcgtacggtccggtaccgcccgtacgttcggcccgttcgccgtacgtccccgtacccgtaagggttccgttaccggaccgtacccggaacggaacccggggacccgggtaaccccgtacggtaccccggacgggtaacccttacccggttaagtacgggttaacggtaacggacccgtaccgggtaccgttaaccgtcccgaaccggttcccgtaccgggtacccggacggttcccggtaggggttaccgggccgttaccggaaccggccgacccgtaacgcccctaaacccgcgtacncccgttactccggtttccccg

SEQ ID NO: 18509 - DNA, 830 bp, Homo sapiens
  misc_feature: GYAE6OF01CCFW4.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccagaggtcgcccctgaacctgaacggccaatgacgacccaagacacggaccaaggtggtgtcgacgaccccgtggacggagccgtcgggcccgtcggtcccgacggcgacggccgtccgtcggccccgtggccgtggtccgtcggtcgtcggggtcgtcgggacccgtaggtcggtccggccccgtacgtcgggtcccgttggtcccgtccggacccggtaccccgtaaggtttcgggttacggacccgtaacccgggaacccggaaaccggggtaccccgggggaaaccccgtaacccgggtaacccccggtacgggtaacccggacccgtttacccggtaacggggtttaccggaaacgggtcccggaaccggtaccccggtaaccgttaccccggacggtaccccggtacgggacccgggtaccgggtcccgggttacgggggtaccgggggtcccggaacggggttaccccggacccgggaacccccgaaaaccccggggtacccccgaaccccccggttaacgttacccggtaaccccgtacccgtttccccggtttaccccccggg

SEQ ID NO: 18510 - DNA, 924 bp, Homo sapiens
  misc_feature: GYAE6OF01EYMFC.14.70.G04.1.454.CMB.1.raw
  modified_base (191)..(191): a, c, t, g, unknown or other
  misc_feature (191)..(191): n is a, c, g, or t
tcagcgtctagtaccacgaccggtgctcgatttagtgtagtgtgaagggaaaggggagggcagttggtagatgccccctctgggagagactccccgaggggtgacagccatggaccctggaaggcctgggctagggacagggaccagagccagtccgagggagaggacagagccaagtcggacgtggggtntacgtagtaacacgcctgctggcgaggacgggaccgacgggcacccgtcctccgagggacgcccatcgctgcgtaacggccggccgaggacggtccaccccgtagaacccgtaggaaccggaccaagtacgaacccgaacccgtaaagaccgtaacggaccggtaaaggttcggggtttagtacggacccgaccccgtagggaacggaccggtccggttccgggaccccgttcggtaccccgacgggtccacgggtcccggtccgttcccggccccgttcggccgtggcccgttggaccggtttcgggtccgtcggtacgtacggttccggtccccgtacggtcgttccgggtcctgtcccgttaccgacccgttaacggtggttcccggtaccgaaccccggacccgggtaacggaacccggggaccccggggaaacccctaccggtaaccccgggtgggaaccccgtttcccgacgggttacggggtaacccgggaaccgtacccggggaacctacccggttaaccgtccccgacgggttaaccccggtcgggtacccccggggtacggtcccccggggttaaggggtacccgggggttccggaaacccggggttccccggaaaacccgggtaaccccccggaaaccccgggttaccccccctaaaaccccggttcccgggttacccggaacccgttttacccccccgggttccggtttaccccccccggg

SEQ ID NO: 18511 - DNA, 704 bp, Homo sapiens
  misc_feature: GYAE6OF01EE15Z.14.70.G04.1.454.CMB.1.raw
  modified_base (316)..(316): a, c, t, g, unknown or other
  misc_feature (316)..(316): n is a, c, g, or t
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagaagccagtccagggagaggacagagccaatggactggggtgtactgtaacagccctgctggcgagagggaccagggcaccgtcctccgaggagcccatgctgcaaggtcggcagacggtcgccctgaacctgaaggccaatgacacccaagacaggccaagtgggttcgngacgacccgtaggaggaggctgggcccgtggtcccacgggccaggcggcgtcggccccgtgtcgtcgcctggccgtcgggtcgtcggccgtacgtcggtaccgtcccgtacgtcgggtccgtcggccgtcggccgacccgttaacggttcggttcgaccgtaaccggaaccgaaacggggcccggggaaccccaccggtaacccgttcgggaccggtccgtacggtacggttacgggaaaccgcgtacgggacccgtacgtccgacgtacccggcgtaccgggcgtccgggtgggtacggggccgtagggtcccaccggggaccccgtaaaccgggaacccccgtaaccccgtacgtacgtaccctacccgttcccggttacccccgg

SEQ ID NO: 18512 - DNA, 825 bp, Homo sapiens
  misc_feature: GYAE6OF01EJ5H2.14.70.G04.1.454.CMB.1.raw
  modified_base (801)..(801): a, c, t, g, unknown or other
  misc_feature (801)..(801): n is a, c, g, or t
tcagcgtctagtaccacgaccggtgctcgatttagtgtagtgtgaagggaaagggagggcagttggtagatgcccctctgggagagactccccaggggtgacagccatggaccctggaagggcctgggctagggacagggaccagagtcagtccagggagaggacagagccaagtggacgtgggtatactgtaacagccctgcgtggacgaggacgggaccgagggcacccgtccgtaccgagggacgcccagtcgcgtgcaaggtccggccgaggacggtcgccccgtagaaccgtagaacggaccaagtacgaaccgaacccaaggaccgaacggacccgtaaggtagggtttacggtacggaaccggacccccgtagggaacgggacggtccggtaccggggtccccgttacgggtaccccgacgggaccgtacggccggtccgtcccggccccgtggccgtcgtccggtcggtccggtcgggtaccggtcggccgtacgtccgggtcccgcccgtagtccggtccgtcggtcccgtccggccgtaccgtaacggttcggtaccgaccggtaaccgaccggaaccgggtacccgggaaccccgaccggaccggtcggaccgtccctacggtacggtaaccggactacccggaaccgtaccggtacgtacccggtacgtcccggtaccggaccggaccgggtccggtcggggtacccggggacggtacccgggtaccccggaccggtaacccccggaacccggtaccccctaaccccggtaccgttaccggttaacccncccgttaccccggtttaccccccg

SEQ ID NO: 18513 - DNA, 805 bp, Homo sapiens
  misc_feature: GYAE6OF01D9ZHF.14.70.G04.1.454.CMB.1.raw
  modified_base (191)..(191): a, c, t, g, unknown or other
  misc_feature (191)..(191): n is a, c, g, or t
tcagcgtctagtaccacgaccggtgctcgatttagtgtagtgtgaagggaaaggggagggcagttggtagatgcccctctgggagagactccccgaggggtgacagccatggaccctggaagggccgtgggctagggacagggaccagagccagtccgagggagaggacagagccaagtggacgtggggtntactgtaacagccctgctggcgaggacgggaccacgggccacccgtccgtccgaagggaccacccagtgcgtcgacgacggtccggaccaggacgtccgccccgtagaaccgtaggaaacgacccaagtcgaccgaaacccgaagaaccgaacggaccgtaaagggttgggtttaacgacggaaccggtaccccggtagggacgggtacggtccggtaccggggtccccgtcgggtaaccccgacggtacccgcggtaccggtcgttcccggaccccgtgtaccgtgtacgtcgtacgtcgggttcctaccggcctagggtccggcccaccgtagttccgtaccgtgcccgtggacccgtacggttagttcgtaccggaaccctaccgggaaccgtaaccgggacccgggtaacccgtaaccggtacccggtacgggtacgtaccccgtttagaaccgggttaacgggaccgttacccgaacggtacccgaccttacggaccgtaccgggtcggaccgggtactcccggggttaggacgggtacgaccgaacccgaccggaaaccccgcgaaacccctcccggtaactccgtaacctccgtcccgttacccccg

SEQ ID NO: 18514 - DNA, 860 bp, Homo sapiens
  misc_feature: GYAE6OF01DYW1Y.14.70.G04.1.454.CMB.1.raw
  modified_base (232)..(232): a, c, t, g, unknown or other
  misc_feature (232)..(232): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctggctagggacagggaccagagccagtccaggagaggacagagccaatggactggggtgtactgtaacagccctgctggcgagaggaccaggcaccgtcctccagggancccatgctgcaaggtcgggccagacggtcgcccctgaaccgttgaaacggccaaattggaagaaccccgaaagaaccagggacccaaaggttcgggtttagtaggtaacggacccccgttaggacggaacggccgttcgggggtaccccgttgggttacccccgagggacccgacgtaccggccgtcggtcccccgttggccgtttgccgttggtccgttaggggttcctggcccgtacgttcggggtcgtccccggtacggttcgggtcccgttcggcccgtttaccggaacccggtcccgtaaacgggtttccgggtttacgggaaccgtaaacccgggtaacccgtaaaaccgggacccgggggggtaaaccccctaaccggggtaccccggttaacggggtacccggaccccgtttaccgggttaacggtttaacgggaacggttacccggaacggtaccccggacgttacccgaacggtcccgttacggggccgtacgggtccgttacggggtaccgggggcgttaaccggggtcccgaaaccgggttaccccgaaccgggaacccccgtaaaccccgtaacccgttaccgttacccgtaccgttccccggtttacccccggg

SEQ ID NO: 18515 - DNA, 877 bp, Homo sapiens
  misc_feature: GYAE6OF01DTGQP.14.70.G04.1.454.CMB.1.raw
tcagcgtctagtaccacgaccggtgctcgatttagtgtagtgtgaagggaaaggggagggcagttggtagatgcccctctgggagagactccccaggggtgacagccatggaccctggaacgggccgtgggcgtagggacagggaccagagccagtccgagggagaggacagacgccaagtggacgtggggtgtactagtaacacgcctgcgtggcgaggacgggaccgagggccacccgtcctccgagggacgcccatcgctacgacgaacggtccgggaccaggacggtccgcccctaggaacccgtaggaaacggaccaagtacgaaccgaaccccgaaagaccgaacggaccgtaaagggttcggggtttacgacggaacccgtaccccggtagggacgggacgtccggtcggggccccgttcgggtacccccgaagggccgacggccgaccgtccggccccgtgtcgtcggacgtcggtcggttacgggtccgtcggacctcgggttccgggtacccgccccggttagggtccggcccgttgacccggtcgggtacccccgtacgttaagggttcccggttacgaccccgtaaaccgggtacccggaaaccggggccccgggttaaccccaccgggtaaccccgtgggtaccctcccgttaaggtacgggtaaccggaacggtcccgaccgggtaccccgacgttaccccggacggtccgtaacgggccccgggtaacgccggggttcggggttaccgggacccgtttaacggggtccccgaaaccggaccccccggtaaacccggaacccccccgtaaacccgttcccgtacctttaaccccggtccccgtttccccgggttacccccccc

SEQ ID NO: 18516 - DNA, 716 bp, Homo sapiens
  misc_feature: GYAE6OF01BL967.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgcgtggcgagagggaccagggcaccgtcctccagggacgcccatgctgacaacggtcgggccaggaggtcgcccctgaacccgtgaacggccaaagtacgaacgaacccaagaccaaggacccgtaaggtagggttgacggacgaccccgtaggaggacgcgtcgggcccgtcggtcccaggcgacgcgtcgtcggccctgcgtgctcggcgtcgggtctacggcctagtcggtaccgccgacggttccggcccgttcgtccgtcggcccgtacccggtaagttccgggttacgccgtaaccggaaccggtaaccgggccccggggaacccaccggtacccgtacgggacccgtaccgttacgagggttacgggaacgccgtaccgggtacccgtaacgtcccgacggcccgtagggaccgggtacgccgggttgggtccgggcgtacgggtcccgacggacccgaacccggacccctaaccccgtacgtacccgtcctccgttcccgttaccccg

SEQ ID NO: 18517 - DNA, 678 bp, Homo sapiens
  misc_feature: GYAE6OF01BOEQK.14.70.G04.1.454.CMB.1.raw
  modified_base (239)..(239): a, c, t, g, unknown or other
  misc_feature (239)..(239): n is a, c, g, or t
  modified_base (449)..(449): a, c, t, g, unknown or other
  misc_feature (449)..(449): n is a, c, g, or t
tcagcgtctagtaccacgaccggtgctcgatttagtgtagtgtgaagggaaaggggagggcagttggtagatgcccctctggggagagatccccaggggtgaccagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccaggacggtcgcccctgaacctgaacggccaatgacgacccaagacaggccaaggtgggtgtggacgacccctggacggagcgtgggccctgggtccccaggcagcgctcggcccctgctgctgcgtgggtctcggcctagtcggtccgcccgagtcggccctgccgtcgccgtcccgtaagtcgggttcnccgtaacccgacggaaaccgggccggggaaccccaacgggacccgtacggggaccgtaccgtaccggtacggttacggaacggaccgaccggaccgtacgtcccgacgggtcccgtacgggccgggtacggtccgtcggggacggggtccgacgggttaccgacccggaccccgaacccgggaacccccacccgtaccgtaccggtaccctccgttcccgttcccccgg

SEQ ID NO: 18518 - DNA, 769 bp, Homo sapiens
  misc_feature: GYAE6OF01A4ZIZ.14.70.G04.1.454.CMB.1.raw
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggacgtggggtgtactgtaacagccctgctggcgagacggaccagggccaccgtcctccgagggcgcccatgctgcaagtcgggcaggagtcgccctgactgacgcaatgacgaccaagacgacggcgaaggtggtcgtcgacgccctggaggacgcgtcggccgtcggtaccgcggcgacgccggcgtccggcccctgtcgtcgccgtcgtcgtcgggtcgtcggaccgtacggtccggtccgacccgtggtccggtccgtaccgtcgtacccgtcccggtaaccccgtaacggttcgggtaccgacccggtaacccggaaccggaaacccgggcccgggtaaccccgaccggtaaccccgtgggacccgtccgtacggtacggtacgggaaccgccgtaaccggtcccgactacccgaccgggtacccggtcgggcccggtaccggtcccgggttacgggtaccggggtccggtaaccgggtacccggaaaccccgggtacccccggaaaccgggttacccccccgtaaacccgttaccggtttaccccggtttaaccccgtttccccggttcccccggttacccccccggg

SEQ ID NO: 18519 - DNA, 723 bp, Homo sapiens
  misc_feature: GYAE6OF01ESQ1V.14.70.G04.1.454.CMB.1.raw
tcagcgtctagtaccacgaccggtgctcgatttagtgtagtgtgaagggaaaggggagggcagttggtagatgccccctctgggagagatccccaggggtgacagccatggaccctggaagggcctgggctagggacagggaccagagccagtccgagggagaggacagagccaagtggacgtggggtagtactagtaacacgccctgcgtggcgaggacgggaccgagggccacccgtcctccgagggacgcccatcgctgacgaaggtccggcgaggacggtcgccccgtgaaccgtaggaacgaccaagtcggaacgaacccaaggacgacggaccgaaggtgggttgtacggaccgaccccgtagggacggacggtccgtacgggcccgtcggtccccgaggccgacggccgccgtcggccccgtgccgtgcgtcgcgtcggtcgtcggtcctaggtccggtcccgccgacgtcggccgtgccgtccgaccgtaccgtacgtggtccgaccaccggacggaaccgggccgggtaacccacggacccgcggacgtaccgtcgtacggtacggacgacgtaccgaccgacgtccgaccgtccgcgggaccggacggtccggtgggtcgggtaccgtagggtacccggaaccggtacccggaacccggtacccccgaaccccggttacgtacccgttcccgtacgttccccggtaccccccg

SEQ ID NO: 18520 - DNA, 757 bp, Homo sapiens
  misc_feature: GYAE6OF01ETVVG.14.70.G04.1.454.CMB.1.raw
  modified_base (236)..(236): a, c, t, g, unknown or other
  misc_feature (236)..(236): n is a, c, g, or t
tcagcgtctagtaccacgaccggtgctcgattttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgcgtggcgaggacgggaccagggccacccgtccnccgagggcgccatgctcgacgaacggtccgggaccaggacgggtccgaccccgtacggtaacccgtacggaaaccggaccgtaaacgtacggaaccgaaacccgaaacggaacgaaccgggaacccggttaaagggttcgggggtttacggtacggaaccggtaccccgtaggggaacgggtacggtccggtccggggccccgttcggtaccccggacgggcgacggccgcgtccggccctcgcgtcgcgtcgcggttggtccgtcggcctacggtcgtaccgccgtagtccgcgtcgccgtccgccgtacctaggtcggtcgacgtaccggacgaccgggacccggaccgtacgaccgtcggaccgtcgtacgtacggacgaacgcgaccggcgtacgaccgtacgacggtccggacggtccgtcggtacggggccggtacggtcggtacgaccccgaaccggtccccgaaacccccgtaccgtaccgttaccggtacccgtccgttaccgttcccccgg

SEQ ID NO: 18521 - DNA, 744 bp, Homo sapiens
  misc_feature: GYAE6OF01BSLRQ.14.70.G04.1.454.CMB.1.raw
  modified_base (187)..(187): a, c, t, g, unknown or other
  misc_feature (187)..(187): n is a, c, g, or t
  modified_base (247)..(247): a, c, t, g, unknown or other
  misc_feature (247)..(247): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggacgtggggtntactagtaacagccctgcgtggcgaggacggaccgagggccaccgtcctaccgaggggcncccagtgcgtgacgaaggtccggaccgaggtacggtccgccccgtagaaccgtaggaacggaccaaagtcgaaccgaacccgaaagaaccgtacggacccgtaaggttcgggttacgtacggaaccgtaccccgtaggaacggacggtccggtaccgggtcccgtcgggtaccccgacgggaccgacggccgtccggtccggtcccgtcgcgtcgcgtcggtcgtcgggtcgtcgacgtacgtcgtccgaccgtcgtcggccgtcgtccgtcgccgtaccgtagttcggcgaccgaaccggacggaaccgggaccgggacccgacgacccgtaggacgtcctacgtacggtacggacgtcgaccgtaccgaccgtaccgaccgtcgacgggccgccggttcggcgggtcgggaccgtcgggaccgacccggacccggtaaccccggaccccgtaaaccccgtccgtaccgtcccttcccggttacccgttccccccg

SEQ ID NO: 18522 - DNA, 747 bp, Homo sapiens
  misc_feature: GYAE6OF01EKUH5.14.70.G04.1.454.CMB.1.raw
tcagcgtctagtaccacgaccggtgctcgatttagtgtagtgtgaagggaaaggggagggcgtagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggccaccgtcctccgagggacgcccatcgctgcaaggtcgggaccaggacggtcgccccgtagaacctgaacggccaatcggacgaacccaagaacaggaccaaggtgggttgtcgacgacccgtggacggaggcgtacgggcccgtcggtccgacggcaggcgcgtcggcccgtgctgcgtcgcgtgggtcgtcggctcggtcggtccgcccgtagtccggtcgtcggtccgtccggaccgtacccgtaacgttcggtccgacccgaccggtaaccggaaccggggacccggggtaaccccgaaccggtacccggacgggtaccgtacccgttacggtacgggttaacggtaacggaccgacggtacccggaaccgtcccgacgggtcccgttacgggacccggtacgggtccggtacggggttacggggtcggtacggggtaccgtaccgggaccccggaacccggacccccgtaaaccccggtaccttaccggtaccccgtaccgttcccgtttaaccccccg

SEQ ID NO: 18523 - DNA, 747 bp, Homo sapiens
  misc_feature: GYAE6OF01D0DMY.14.70.G04.1.454.CMB.1.raw
  modified_base (186)..(186): a, c, t, g, unknown or other
  misc_feature (186)..(186): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggactggggtntactgtaacagccctgctggcgagagggaccagggcaccgtcctccgagggacgcccatgctgacaaggtccggccaggacggtcncccctgaacctgaacggccaagtgaagacccaaagacaggccaagtgggttgngacgacccgtgaggagcgtggcctggtccaggcagccgcgtcggccccgctcgtcctcgccgttcggggtccgtcgggccgtaacgtccggtacccgccccgtaaggtccggtcccgtacgtcgttccggacccggtaccccgtaaaggttccgggttaccggcccgaaacccggaccggtaaaaccgggcccggggaaccccaacgggtaaccccgtagggaccgtcccgtacgtacgggttacgaacggccacggaccgtacgtacccgtacgcccggttacggaccggtaacggtcccggtagggtccggggtaccggtacgggttacccgaacccggaccccgtaaacccgggaccccctaaacccccgtacgttacccgtaaccgtaacccgttcccgttacccgttaacccccccg

SEQ ID NO: 18524 - DNA, 779 bp, Homo sapiens
  misc_feature: GYAE6OF01EQ2S3.14.70.G04.1.454.CMB.1.raw
  modified_base (296)..(296): a, c, t, g, unknown or other
  misc_feature (296)..(296): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (748)..(748): a, c, t, g, unknown or other
  misc_feature (748)..(748): n is a, c, g, or t
tcagcgtctagtaccacgaccggtgctcgatttagtgtagtgtgaagggaaaggggaggcagttggtagatgcccctcgtgggagagactccccgaggggtgacagccatggacccgtggaacgggccgtgggctagggacacgggaccagacgccagtccgagggagacggacgagacgccgaagtcgggacggttggggtagttacctacggtaaccacgtccccgtgtacgttcgggacggacgggtaacgggaccgtaggggccgaacccgttccgtacccggaggggaccncccgtatcgctcgtaccgaaaggccggaccgaaggtacggtccgaccccgtgaaccgtaggaaccgtccaagtacgaccgaaccgtaacgacggacgtaccgaggttcgggttaggacgtaccgccggtaggacggngtccgtccgggtccgtcggtccncggagacccggccgttcgcccggtccctgtaccgngtccgtgtacggtcggtccgaccgtacgtctccgggtacnccggtancccggtcgtcgctccgaccgtcgtaacggtcgacgttacggaccgtaacgggaccgggacccgggtaccgaccgggtaaccgtcgtaccggtaccgtacgggttcggtaaccggacgacccggtacgtaccggaccgacccgtacgccgtcggacggtacggcggtcgggtaccggcgtacggccgaacgtaccccgagaccccgaaccnccgtacgttcccaccggttcccgttaccccg

SEQ ID NO: 18525 - DNA, 710 bp, Homo sapiens
  misc_feature: GYAE6OF01A4UHA.14.70.G04.1.454.CMB.1.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (482)..(482): a, c, t, g, unknown or other
  misc_feature (482)..(482): n is a, c, g, or t
tcagcgtctagtaccacgaccggtgctcgatttagtgtagtgtgaagggaaaggggagggcgagttggtagatcgcccctcgtgggagagactccccgaggggtgacagccatggacccgtagggaacgggccgtgggctagggacacgggaccagacgccaggtccgagggagaggacaggagaccaagtggacgtgggtgtacgtgtaacacgtcctgcgnggacgaggacggacgacggtacnccgtaccgtaccgacggggaccnccctagtcgctacggacgtacggcgggaccaggacggtccnccccgtagaacccgtaggaacgacaagtcgaaccgaccgaagacgacgaccgtaggtacgggtcgacgaccgtccgaggacggacgtcggtaccgggtcctccggaccgcgcggacgccgtcgtccggcctggctcggcacgtcggtacgtctccggatacgtcgccgtccnggtcgccgtcgtcgcgccgtcgtacgtcggtcgacgtaccggacgaccggaccggacccgaccgtaccgcggtaccgtcgtaacgtcggtacggacgacgaccgtaccgtacgacgtacgtcggtaccggcgtaccggtcggtacgggcgggtccgtaagacccggtaccgacccgtaaccgaccccgtaaccgtacccgtacgtacccgtccgttcccgtaccccgg

SEQ ID NO: 18526 - DNA, 950 bp, Homo sapiens
  misc_feature: GYAE6OF01CZD9V.14.70.G04.1.454.CMB.1.raw
tcagcgtctagtaccacgaccggtgctcgatttagtgtagtgtgaagggaaaggggagggcagttggtagatcgcccctcgtgggagagactcccgaggggtgacacgccagtcggacccgtagggaacgggccgtgggacgtaagggacgaacgggaccaaggacggacccgagtaccggaagggacgaaggaacgagacgaccaagtggacgtgggtagtacgtagtaacgcgccgtgcgtggacgaacggacggaccgacgggacacccggtccgtacggacgggacgacctagtgaccgtagaccggaaacggtccggacgaacggtacggtccgacccgttaacggaaccgtacggaaacggtaccgaagtacggaaaacccgaaccgaaacggaaccggacggtaaaccggtaagggttcgggttaacggtaaccggaaccgtaacccggtagggtacgcgttaccgggccgtaacccggtcggtaccgaagtcccgacggccggtacccgtcggtaccccgtgtaccgtcggtccggtaccggtcgttacggttaccggacgtacccgtacggttacccgggcctaccggtacgttccgggccttacggccgttacccggccgtaacgttacggtacccgtaccgaacccgtaaccgggaaacccggaaccgggtacccggaacccggtaacccggtaacccggtaaccggtacccggttaaacccggtaccgggtaaacgggttaacccggaacggttacccggaaccgtaacccggaccgtccggttaaaccggtccggaaccggtaccggtaccgggttccgtaccgggggaccgggtaacccgtaccggggtaacccgaccccggtaaaccccgggaaccccgtaacccccgtaacggttaccgtacccggtacccctacggttccccccgttacccgg

SEQ ID NO: 18527 - DNA, 660 bp, Homo sapiens
  misc_feature: GYAE6OF01B0U0N.14.70.G04.1.454.CMB.1.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (407)..(407): a, c, t, g, unknown or other
  misc_feature (407)..(407): n is a, c, g, or t
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagaggacagagccaatggacgtggggtgtactgtaacngccctgctggcgaggacgggaccagggcacccgtcctccgagggacncccatgctgcgaagtccgggccaggaggtcgcccccgttgaaccctggaacggaccaaatggaacgaacccaagacgacggaccgaaggttgggtgtacggacgaccccgtggacggacgcgtcgggccctcggacccgaggcgacgccgcgtccgccccgtnccgtcgcgtgtcgtcggtcgtacggccgtacgtcggccgcccgtagtcggtacctcgtccgttacggccgtaccgtagttcggtaccgccaaaccggacgaaccgggccgggaacccgaccgaccgtacggacctccgtagacggtagaacgcgacgtccgaatccgacgtccgacggtcggacggtccgtagggtcggaccgtaggccggacgtacccgaccgacccgacctcgcactaccgtcgtaccccg

SEQ ID NO: 18528 - DNA, 681 bp, Homo sapiens
  misc_feature: GYAE6OF01BZMTY.14.70.G04.1.454.CMB.1.raw
  modified_base (184)..(184): a, c, t, g, unknown or other
  misc_feature (184)..(184): n is a, c, g, or t
  modified_base (607)..(607): a, c, t, g, unknown or other
  misc_feature (607)..(607): n is a, c, g, or t
  modified_base (659)..(659): a, c, t, g, unknown or other
  misc_feature (659)..(659): n is a, c, g, or t
  modified_base (666)..(666): a, c, t, g, unknown or other
  misc_feature (666)..(666): n is a, c, g, or t
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacgcccatcgctgacaaggtcgggaccaggacggtcgcccctagaacctggaacggaccaagtggacgaaccaagacgaggaccgtaaggttgggtgtagacgacccgtggaggacgtcgtcgggccctggtccccgaggccgagccgcgtaccggccccgtgccgtcgcgtcggtcgttcgggtaccgtcggtacccgtagttccgggtacccgcccgtacgtcggcccgttcgaccgttccggccgtacccgtagtccggttcgacccgtacgaccggtaaacgggccgggtaacccgaccggtacccgtcggacgtacccgtacgtacggtacgaacgtccgacgaccgacgttacccgcggtaccgnggccgacgtccgtgggtcggcgtaggccaccggacccgacgacccctaaccnccgtacnctcctccgtaccccg

SEQ ID NO: 18529 - DNA, 747 bp, Homo sapiens
  misc_feature: GYAE6OF01AKNUP.14.70.G04.1.454.CMB.1.raw
  modified_base (251)..(251): a, c, t, g, unknown or other
  misc_feature (251)..(251): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagcgtctagtaccacgaccggtgctcgatttagtgtagtgtgaagggaaagggagggcagttggtagatgccctctgggagagatccccagggtgacagccatggaccctggaaggccgtgggctagggacgagggaccaggagccgagtccagggagaggacagaggccaagtggacgtggggtgtacgtgtaacagccctggcctggcgaggaggccagggccaccgtcctcgaggacgccagtcgntgacgaggtccggcgtaggacgttccgcccgttacgaaccggtcgaacggacctaaggtacgaaccggaacccaaggaccgtaacggccgtaaaggtcgggtttagacggtaccgcccggtaggacggacgcgtcgggccttcgggccgaagcgngtaccggcgtacgtccgngtcgtcggaactcggtcgtcgggtctcggccgtacggcggttaccccggtacgtcgggtccgtaccggtcgtccggccgtaccgtaacggttcggtcgtaccggtccgaacggtaccgggacccggaccgtaccgccgtaccggacgtccgtaccggtaacgttacggacgtaccgtaccgacgtaccgtaccgtaccgggtcgtaacccggtccggaccgtaccgggtccggggttccgggacgacccggtcggacccggaccccggaccggtaccccgaacccgtaccgtaccgttacccgacgtttccccgtaccccggg

SEQ ID NO: 18530 - DNA, 576 bp, Homo sapiens
  misc_feature: GYAE6OF01BYJI2.14.70.G04.1.454.CMB.1.raw
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (517)..(518): a, c, t, g, unknown or other
  misc_feature (517)..(518): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (541)..(541): a, c, t, g, unknown or other
  misc_feature (541)..(541): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
tcagcgtctagtaccacgaccggtgctcgatttagtgtagtgtgaagggaaaggggagggcagttggtagatgcccctctgagagagatccccgaggggtgacagccatggaccctggaagggcctgggctagggacagggaccagagccagtccagggagaggacagacgccaaagtggacgtggggtgtactagtaacagccctgcgtggcgaggagggaccagggccaccgtcctccgaggggacgccccagtcgcgtcgcgtaacggtcgggacaggacggtcgccccgtagaaccgtgaacggccaatcgaacgaaccaagaacaggaccaaggtgggttgtaggacgtaccccgtggacggacgtccgtcgggccctcgggtcccagggccagccgctccggaccctgctgctggctaggctcgacgtccaggtcctcgaccgatcgcctgcgtcgcgactagtcgtcgacacgacgacggccgacncgacnggcntcgngtagcagcgcnncgncgcgncggtgcgtggcgtancccgtacgaccgtagacccacncgtcnccgtaccg

SEQ ID NO: 18531 - DNA, 557 bp, Homo sapiens
  misc_feature: GYAE6OF02G7ZS9.14.70.G04.1.454.CMB.1.raw
tcagcgtctagtaccacgaccggtgctcgatttagtgtagtgtgaagggaaaggggagggcagttggtagatgcccctctgggagagactccccgaggggtgacagccatggaccctgggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagaccaagacaggccaagtgggttgtcgagacccctgaggagcgtgggccctggtcccaggcagcgctcggcccctgctgctgctgggtctggccagtggtcgcccatcggcctgctgcgcccatggttgcaccgcgaaacgcgggacccagacccgtggacgcctcaggttcggaagcacgccgactccgagccctgcggacgccgtggtcggggcacgggtcacggacccgaacggcccaaccccgactcgtccacctctcccg

SEQ ID NO: 18532 - DNA, 555 bp, Homo sapiens
  misc_feature: GYAE6OF02I0SR8.14.70.G04.1.454.CMB.1.raw
  modified_base (471)..(471): a, c, t, g, unknown or other
  misc_feature (471)..(471): n is a, c, g, or t
tcagcgtctagtaccacgaccggtgctcgatttagtgtagtgtgaagggaaagggagggcagttggtagatcgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccgatgctgcaagtcgggccagaggtgcccctgaacctgaaggccaatgagacccaagacaggccaaagtgggttgtgagacccctgaggagctgggccctggtcccaggcagcgcgtggcccctgctgctgctgggtctggccatggtccgccagtcggcctgctcgcgccccaatggttcgcaccgcaaacgccggggacccaggaccctggacgcctcgagttggaacncgagccgatccagccctgcgagccgtgtcggggcagggtcaaggcccgaaggcccaaccccgctacggtccaccgtctacccgg

SEQ ID NO: 18533 - DNA, 539 bp, Homo sapiens
  misc_feature: GYAE6OF02GAPYD.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccatcggcctgctgcgccaatggttgcacgcgaacgcgggacccagaccctggacgcctcagttggaagcgagccgatccagcctgcgagccgtggtcggggcaggtcacggcccgaacggcccaacccgacgtcgtcctacctctcccg

SEQ ID NO: 18534 - DNA, 572 bp, Homo sapiens
  misc_feature: GYAE6OF02IKBOF.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctcggccctgctgctgctgggtctgaccatggtcgcccatcggcctgcctgcgcccaatggttgcaccgcaaacggccggggaacccaggaccccgtggacgccgtcacggttggaacgtcgagcccgactcccgaagcccgtagccgggacgccgtggtcgggggcacgggtcacggcccgaacgggcccaaccccgacgtcgtaccacctccttcccgg

SEQ ID NO: 18535 - DNA, 541 bp, Homo sapiens
  misc_feature: GYAE6OF02FT9JL.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggcccctgctgctgctgggtctggccatggtcgcccatggcctgctgcgcccaatggttgcaccgcaaagcggggacccagaccctggacgcctcagttggaagcgagccgatccagcctgcggagccgtgtggggcagggtcaggccccgaaggcccaaccccgaccgtcggtaccaccgtcctaccg

SEQ ID NO: 18536 - DNA, 521 bp, Homo sapiens
  misc_feature: GYAE6OF02HV5ZH.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggtgcacgcaaagcgggacccagaccctggacgcctcgagttggaagcgagccgatccagcctgcgagcctgcgggcaggtcagcccaaggccaacccactcgtcactctccg

SEQ ID NO: 18537 - DNA, 599 bp, Homo sapiens
  misc_feature: GYAE6OF02IR225.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgagacccaagacaggccaagtgggttgtgagacccctgaggagctgggcctggtcccaggcagcgctggccctgctgctgctgggtctggccagtcggtcgcccgatcgggcctgcctcgccgtcccaagtcggttcgccgtaccgacgaaacggccggggaacccacggaccccgtggacgcccgtcgaggttggaacgcgagccgactccgacgccgtgccggacgccgtggtcggggcacgggtccgacggtaccccgaacggtaccccaaccccgtaccgtacggtaccctaccgttccgttaccccgg

SEQ ID NO: 18538 - DNA, 597 bp, Homo sapiens
  misc_feature: GYAE6OF02HXC8J.14.70.G04.1.454.CMB.1.raw
  modified_base (418)..(418): a, c, t, g, unknown or other
  misc_feature (418)..(418): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccagtcggcctgcctgccgcccaatggttncaccgcgaaacgccgggacccaggacccctgggacgcctacgacggttggaacgtcgaggcccgattcccgacggtcctcggaccggacgcccgtgggtcgggggtccaggggtccacggcccccgaaagggcccctaaccccgaccgttaccggtaccctaccgtcccgttaccccgg

SEQ ID NO: 18539 - DNA, 587 bp, Homo sapiens
  misc_feature: GYAE6OF02GIZOV.14.70.G04.1.454.CMB.1.raw
  modified_base (495)..(495): a, c, t, g, unknown or other
  misc_feature (495)..(495): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggcctggtcccaggcagcgctcggccctgctgctgctgggtctggccatcggtcgcccgatcggcctggcctcgccgcccaagtcggttcgcaccgcgaaacggccggggaacccacggacccgtggacgccgtcgagttggaacgcgacgccgactccagcccnggccggacgccgtggtcggggcacgggtccgaacggccccgaacgggccccaaaccccgtaccgtaccggtaccaccgttcccgttacccgg

SEQ ID NO: 18540 - DNA, 572 bp, Homo sapiens
  misc_feature: GYAE6OF02F9NTX.14.70.G04.1.454.CMB.1.raw
  modified_base (376)..(376): a, c, t, g, unknown or other
  misc_feature (376)..(376): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtgggttgtgagacccctgaggagctgggccctggtcccaggcagcgctggccctgctgctgctggtctggcntggtcgcccatcggcctgctgccgcccaagtggttcgcgaccgcgaaacggccggggaacccaggaccccgtgggacgccctcgacggttggaacgcgacgccgactccgagcctgccggacgtccgtggtcggggcgtaggtccgacgcccgaacggaccccaacccgtacgtccgtacctaccgtacgttcccg

SEQ ID NO: 18541 - DNA, 427 bp, Homo sapiens
  misc_feature: GYAE6OF02GLT6H.14.70.G04.1.454.CMB.1.raw
  modified_base (426)..(427): a, c, t, g, unknown or other
  misc_feature (426)..(427): n is a, c, g, or t
tcagcgtctagtaccacgaccggtgctcgatttagtgtagtgtgaagggaagggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaagggactacttccgtactagacgctgagcgggctgggcaaggcgcatagnn

SEQ ID NO: 18542 - DNA, 540 bp, Homo sapiens
  misc_feature: GYAE6OF02HRXGR.14.70.G04.1.454.CMB.1.raw
  modified_base (405)..(405): a, c, t, g, unknown or other
  misc_feature (405)..(405): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggccctgctgctgctggtctggcagtcgtcgccatcggctgctgcgccatgtncacgcaagcgggaccagacctggacgcctcgagttggaacgcagccgatccagcctgccggagccgtggtcggggctagggtccaacggccccgaaagggccccaaccccgacgttcgtaccaccgtcctcccgg

SEQ ID NO: 18543 - DNA, 530 bp, Homo sapiens
  misc_feature: GYAE6OF02F0C3Z.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggcctggtcccaggcagcgctggccctgctgctgctgggtctggccatggtcgcccatggcctgctgcgcccaatggttgcaccgcaaacgcggggacccaggaccctggacgcctcgagttggaagcagccgatccagcctgcgagccgtgtggggcaggtcacggcccaaggcccaacccgactcgccactccttccg

SEQ ID NO: 18544 - DNA, 509 bp, Homo sapiens
  misc_feature: GYAE6OF02I9CHC.14.70.G04.1.454.CMB.1.raw
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagaccctgaggagctgggccctggtcccaggcagcgctggcccctgctgctgctggtctggccatggcncccatggctgctgcgccatggtncacgcaagccgggaccagaccctggacgcctacgagttggaacgcagccgatccagcctgcgagcgtgtgggcaggtcagccaggccacccncngtcactctcg

SEQ ID NO: 18545 - DNA, 590 bp, Homo sapiens
  misc_feature: GYAE6OF02F4OB6.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccagtcggcctgctcgcgcccaatcggttcgcaccgcaaacggcgggacccacgaccctcggacgcctcgagttcggaagcgacgccgactccgacgccgtcggccggacgtcccggtggtcgggggcacgggttaccgacggccccgaaacggacccgaaaccccgaccgttaccggtaccctaccgtcccgttccccgg

SEQ ID NO: 18546 - DNA, 556 bp, Homo sapiens
  misc_feature: GYAE6OF02GRQFB.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggcctggtcccaggcagcgctggcccctgctgctgctgggtctgggccagtcggtcgcccgatcgggcctgcgtgcgcccgaatggttgccaccgcgaaacgcggggacccagacccgtggacgcctcgagttggaacgtcgagccgatccagcctgcggacgccgtggtcgggggcagggtccgaggcccgaaggcccaaccccgacgtcgtacacctctcccg

SEQ ID NO: 18547 - DNA, 541 bp, Homo sapiens
  misc_feature: GYAE6OF02I32HF.14.70.G04.1.454.CMB.1.raw
  modified_base (521)..(521): a, c, t, g, unknown or other
  misc_feature (521)..(521): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctcgcgcccatggttgcaccgcaaacgcggggacccagaccctggacgcctcgagttggaagcagccgatcccgagccctgcggagccgtggtgggcaggtcgaacggcccaaggcccaacccncgtacgtccacctctacccg

SEQ ID NO: 18548 - DNA, 531 bp, Homo sapiens
  misc_feature: GYAE6OF02GNUSN.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtggtcgcccatggcctgctcgcgcccaatggttgcaccgcaaaggcgggacccagaccctggacgcctcagttggaagcagccgatccagcctgcggagccgtgcggggcaggtcacggcccaaggcccaacccgactcgcactcctccg

SEQ ID NO: 18549 - DNA, 688 bp, Homo sapiens
  misc_feature: GYAE6OF02FF7AJ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggacggtcgcccctgaacctgaacggccaatgacgacccaagacaggccaagtggttgtgagacccctgaggagcgtgggcctggtcccaggcagcgctcggccctgctgctgctgggtctggccagtcggtccgcccgtatcggcctcgctcgccgacccgtaagttcggttacgccgaacccggacgaaaacggccggggaacccacggacccgttacggaccgtccgtacgtaaggttacggaacggtccgaacggacccgacgttcccgaacgtcccggtacggccgggaccggtcccgtacgggtaccgggggtaccgtaacggggttacccgaacccgggacccccgaaaaccggggtaccccccaaacccccggtaccgttaccggtaccccgttaaccgttccccggtttaccccccggg

SEQ ID NO: 18550 - DNA, 590 bp, Homo sapiens
  misc_feature: GYAE6OF02GIMAW.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccatcgggccctgccgtgccgcccgaagtcggttcgccgaccgccgaaacggccggggaacccacggaccctgggacgcctcgagttggaagcgagccgatccagcctgccggagcccgtggtcggggcgacgggttccgaacggaccccgaacgggaccccgaaccccgaccgttaccggtcctacccgtccgttacccg

SEQ ID NO: 18551 - DNA, 532 bp, Homo sapiens
  misc_feature: GYAE6OF02F8ZLI.14.70.G04.1.454.CMB.1.raw
  modified_base (485)..(485): a, c, t, g, unknown or other
  misc_feature (485)..(485): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatcggtcgcccatggcctgctgcgcccaatggttgcaccgcaaacggccgggacccagaccctggacgcctcagttggaagcagccgatccagcctgcgagccgtgngggcaggtcacggcccaaggcccaacccgacgtcgtcacctctcccg

SEQ ID NO: 18552 - DNA, 578 bp, Homo sapiens
  misc_feature: GYAE6OF02G72W4.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtgcccctgaacctgaaggccaatgagacccaagacaggccaagtgggttgtgagacccctgaggagcgtgggccctggtcccaggcagcgctggccctgctgctgctggtctggccagtcggtcgccagtcggcctgcctcggccgcccaagtcggtcgcaccgcgaaacggccggggaacccaggacccgtggacgcctacgagttcggaacgcgagccgatccgagccctgccgacgccgtaggtcggggcaggtccgacggacccgaacggccccaaccccgacgtaccggtacctaccgtccgttacccgg

SEQ ID NO: 18553 - DNA, 538 bp, Homo sapiens
  misc_feature: GYAE6OF02JDMBV.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaaggccgggacccacgaccctggacgcctcagttggaagcagccgatccagcctgcgagcctggcggggcaggtcacggcccgaacggcccaaccccgacgtcgtccaccgtctcccgg

SEQ ID NO: 18554 - DNA, 549 bp, Homo sapiens
  misc_feature: GYAE6OF02GAGUL.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggccctgctgctgctgggtctggccatggtcgcccatggcctgctgcgcccaagtgtgcaccgcaaacgcggggacccacggacccgtggacgcctcaggttcggaagcgacgccgatccgagcctaggcgagccgtggtcggggcagggtccacggcccgaagggcccaacccgacctcggtccacgtcctacccg

SEQ ID NO: 18555 - DNA, 585 bp, Homo sapiens
  misc_feature: GYAE6OF02JZY52.14.70.G04.1.454.CMB.1.raw
  modified_base (262)..(262): a, c, t, g, unknown or other
  misc_feature (262)..(262): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagaggtncccctgacctgaagccaatgagaccaagacaggccaagtggttgtgagacccctgaggagctgggcctggtcccaggcagcgctggccctgctgctgctgggtctggccagtcggtcgcccagtcggcctgctgccgcccgaagtcggttgcaccgcgaaacggccggggacccaggacccgtcggacgccctcgaacggttcggaagcagtaccgacgtccgaagcctacggcggacgccgtgggtcgggaccgacgggtccgaacggaccccgaacgggccccgtaaccccgcgtaccgtccgtaccgtccgttaccccgg

SEQ ID NO: 18556 - DNA, 584 bp, Homo sapiens
  misc_feature: GYAE6OF02I9XAY.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtccgcccagtcggcctcgcctcggccgcccgaagtcggttcgccgacccgacgaaacggccggggaaccccaggaccccgtaggacgcccgtcgaggttcggaacgtcgacgccgatccgagcccgtgcggagccgtggtcggggcgacggtcgacggacccgaacggcccaaccccgctacgtcctaccgtcctcccgg

SEQ ID NO: 18557 - DNA, 677 bp, Homo sapiens
  misc_feature: GYAE6OF02JW2Q9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctggcctggtcccaggcagcgctcggccctgctgctgctggctggcctagtcggtccgcccgagtcggccgtgcctcggccgcccgtaagtcgggttcgccgtaaccggaccgaaaacggccgggggtaaccccacgggtaccccgtacgggaccgtacccgtccgtaacgggttacgggaacggccgaacggtcccggaacttacccgaaggtccctacgggaccgggaaccggtcccggttcgggtacggggggccgtaaccggggttcgaacccggtacccggaaaccgggccccctaaacccccggaccggttacggtaccctaccggtttaccccgttccccggg

SEQ ID NO: 18558 - DNA, 610 bp, Homo sapiens
  misc_feature: GYAE6OF02GA9QV.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggcccctgctgctgctgggtctggccatcggtccgcccgacgtcggcctgccttgccgcccgaattcggttcgccgaccgacgaaacggccggggaacccacggacccgtgggacgcccgtcgacggttcggaacggcacggccgactcccgacgcccgtggaccggagccgtgggtcggggccgtagggtcccgaacggtaccccgaacgggaccccaaaccccgtacgtaccgtacccgaccgttccttaccccgg

SEQ ID NO: 18559 - DNA, 536 bp, Homo sapiens
  misc_feature: GYAE6OF02GG2D7.14.70.G04.1.454.CMB.1.raw
  modified_base (437)..(437): a, c, t, g, unknown or other
  misc_feature (437)..(437): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggcatggtcgcccatggcctgctgcgccatgttgcaccgcaagcgggacccagaccctggacncctcagttggaagcagccgatccagcctgcgagccgtggtcggggcaggtccacggcccgaaggcccaacccgaccgtcggtacctacgtccttacccg

SEQ ID NO: 18560 - DNA, 640 bp, Homo sapiens
  misc_feature: GYAE6OF02ICZGZ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgcctgcaagtcgggccaggaggtcgcccctgaacctgaaggccaatgagacccaagacaggccaagtgggttgtgacgacccctggaggagctcgggccctgggtccccaggccaggccgcgtcggcccctgctgctgcgtggtctggccatcggtccgcccgagttcggcctgcgtcgccgccctaagtcgggttcgccgtaccgacgaaacggccgggaacccgacgacccgtcgggacgtccgtaccgtaggtacggaacgaccgacgccgacgtcccgacgccgtacggccggacgtccggtggtcgggggctacgggttccgaaccggtacccccgaacgggtaccccgaacccgtacccgttccggacccgtaccgttcccgttaccccgg

SEQ ID NO: 18561 - DNA, 599 bp, Homo sapiens
  misc_feature: GYAE6OF02H2PBY.14.70.G04.1.454.CMB.1.raw
  modified_base (357)..(357): a, c, t, g, unknown or other
  misc_feature (357)..(357): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccgagggagcccatgctgcaagtcgggccagaggtgcccctgaacctgaaggccaatgagacccaagacaggccaagtggtgtgagacccctgaggagctggcctggtccaggcagcgctcggcccngctgctgctgggtctggccatcggtcgcccgagtcggcctggcctcggccgcccgaagtggttcgcaccggtcgaaacggccgggacccacggacccgtcggacgccgtaccgagttcggaacgcgaccggccgacgtcccgacgcctcggccggacggccgtcggtacggggcgacggtccgacggtaccccgaacgggcccaaaccccgcgttaccggacctacccgtacgttaccccgg

SEQ ID NO: 18562 - DNA, 554 bp, Homo sapiens
  misc_feature: GYAE6OF02FQRU2.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccaggggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtcgcccatcggcctgctgcgcccaagtggtgcaccgcaaacggccggggacccaggaccccgtgggacgcctcgagttcggaagcagccgatccgagcctgcgagccgtgtcggggcaggtccaaggccccgaaggccccaaccccgcgtccgtcaccgtctcccgg

SEQ ID NO: 18563 - DNA, 601 bp, Homo sapiens
  misc_feature: GYAE6OF02IOYC6.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctgggtcccaggcagcgctcggccctgctgctgctgggtctggcagtcggtcgcccatcggcctgcgtcgcgcccgaagtcggttcgcgaccgcgaaacggccggggacccacggacccgtggacgccgtcgaggttacggaacgcgacgccgacgtccgagcccgtaggccggacgtccgtcggtcggggcgtacgggtaccgacggaccccgaacggccccgaaccccgtaccgtacgtcccgtacccgttccgttaccccgg

SEQ ID NO: 18564 - DNA, 740 bp, Homo sapiens
  misc_feature: GYAE6OF02I94R7.14.70.G04.1.454.CMB.1.raw
tcagcgtctagtaccacgaccggtgctcgatttagtgtagtgtgaagggaaagggagggcagttggtagatgcccctctgggagagatccccaggggtgacagccatcggaccctgggaacgggccgtgggctagggacagggaccagagccagtccgagggagaggacagagaccaatggacgtggggtgtactgtaacagcctgctggcgaggaggaccagggcaccgtcctccgagggacgcccagtcgctgcaaggtcggccaggaggtcgccccgtagaacctgaacggccaatgacgaccaagaccaggccaagtggttgtgacgaccccgtgaggagcgtcgggcccgtggtcccaggcagcgacgtcggcccctgcgtcgcgtggcgtcgggtactcggccgtagtcggtccgcccagtcggcctgccgtcggccgtccccgaagttcgggttccgaccgtaacccggtaccgtaaaaccggggcccgggggtaaacccgtacggtaacccccgtaggggacccgtaccccgttaccggtaacgggtttacgggaaacgtaccgtacggtaccccggtaacgtacccgtaaacgggtccccgttagggacccggggaccgtacccgggttgggtccgggggaaccgtacgggtcccgtaaccgggaccccgtaaacggggaccccctaacccgtaccgtaccggtaccctaccgttcccgtttaacccccgg

SEQ ID NO: 18565 - DNA, 582 bp, Homo sapiens
  misc_feature: GYAE6OF02GZUP5.14.70.G04.1.454.CMB.1.raw
  modified_base (369)..(369): a, c, t, g, unknown or other
  misc_feature (369)..(369): n is a, c, g, or t
tcagcgtctagtaccacgaccggtgctcgatttagtgtagtgtgaagggaaaggggagggcgagttggtagatgcccctctgggagagatcccaggggtgacagccatggaccctggaagggcctgggctagggacagggaccagagccagtccagggaaaggacagagccaatggactggggtgtactgtaacagccctgctggcgagagggaccagggcaccgtctccagggagccatgctgcaagtcggccagaggtgccctgaacctgaaggccaatgagaccaagacaggccaagtggttgtgagacccctgaggagcgtgggccctggtcccaggcagcgcgtgccctgctgctgctgggtcnggccagtcgtcgcccagtcggctgctcgcgccaagtcggttgccgaccgacgaaacggccggggaacctacggacccgtggaccgccgtcaggttcggaagtccgagccgatccgagccgtaggcggacgccgtgggtcggggcagggtccacggcccgaacgggtccccaaaccccgcgtaccgtaccgtaccttccgtccgttaccccccg

SEQ ID NO: 18566 - DNA, 625 bp, Homo sapiens
  misc_feature: GYAE6OF02G67UX.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtgcccctgaacctgaaggccaatgagacccaagacaggccaagtgggttgtgacgacccctggaggagcgtgggccctggtcccaggcagcgcgtcggcccctgctgctgctggtctggccagtcggtccgcccgagtcggcctgctcgccgccctaagtcggttcgccgaccggaccgaaacggccgggaccccacggaccccgtcggacgccctacgaggttggacgcgacgcccgagtcccgaacggtcccgtcggaccgggacgtccggtgggtacggggcgtacgggtccgaccggaccccgaacgggaccccctaacccccggacgttaccggacccttacccgtccgttccccgg

SEQ ID NO: 18567 - DNA, 596 bp, Homo sapiens
  misc_feature: GYAE6OF02FILX5.14.70.G04.1.454.CMB.1.raw
  modified_base (445)..(445): a, c, t, g, unknown or other
  misc_feature (445)..(445): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgagacccaagacaggccaagtgggtgtgagacccctgaggagctgggcctggtcccaggcagcgctggcccctgctgctgctgggtctgggccagtggtcgcccatggcctgctcgcgcccaatggtcgcaccgcgaaacggccgggacccagacccgngggacgtcctcgaggttcggaacgcaacggccgaagtcccgaagcccgtggccgggaagtcccggtggtcgggggccgagggtaccgacggtccccgaaacgggccccgaaaccccgccgtaccggtacccaccgttcccgttaccccggg

SEQ ID NO: 18568 - DNA, 568 bp, Homo sapiens
  misc_feature: GYAE6OF02GMMC2.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccatcggcctgctcggccgcccaagtcggttcgccgaccggccgaaacggccggggaacccaggacccgtggacgcctcgagttggaagcagccgatccagccgtgcggagccgtggtcgggcgagggtcacggcccgaacggcccaaccccgaccgtacgtcctaccgtccgttcccgg

SEQ ID NO: 18569 - DNA, 615 bp, Homo sapiens
  misc_feature: GYAE6OF02JZ4XJ.14.70.G04.1.454.CMB.1.raw
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatcgcctggccaaggtcgggaccaggacgggtcgcccccgtggaacccttggaaacggcccaaatcgaacgaccccaagacaggccaaggtgggttgtgacgacccctggaggagctcgggccctcggtcccaggcaggcgctcggccctgctgctgcgtgggtctggccagtcggtcgccctagtcggcctgctgccgccgtaagtcggtcgccgaccgacgaaacggccgggacccacggaccctggacgcctgacggttgacgccacggccgtactccgacgccgtgaccggagtccgtggtcggggccagggtacccacggccccgaaggcccccaaccccgtcgtaccgtacctaccgttccgtacccgg

SEQ ID NO: 18570 - DNA, 617 bp, Homo sapiens
  misc_feature: GYAE6OF02H6NZ4.14.70.G04.1.454.CMB.1.raw
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
  modified_base (428)..(428): a, c, t, g, unknown or other
  misc_feature (428)..(428): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaagtcgggcagaggtcgccctgaacctgaaggccaatgagacccaagacaggccaagtggtgtgagaccctgaggagctggccctggtccaggcagcgctcggccctgcctgctgctgggtctggccagtcggtccgcccagtcggcctgcgtcgccgtcccaagtcggttgcctaccggnaaacggccggggaacccacgacccgtggacgcctacgaggttcggaaacgtcgaacggccgactacccgacggccgtaggccgggaacgcccggtgggtccgggggcgtaaccgggttcaaccggtacccccgaaacggccccgaacccccgtacgttaccggtacctaaccccgttcttacccccggg

SEQ ID NO: 18571 - DNA, 568 bp, Homo sapiens
  misc_feature: GYAE6OF02GZ997.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagcgtgggccctggtcccaggcagcgctggcccctgctgctgctgggtctggccagtcggtcgcccatcggcctgctcgcgcccaagtcggttacgcgtaccgcgaaacggccgggaacccacgaccccgtggacgccctcgacgttcggaagccgagccgatcccgagcctggccgagccgtggtcggggcacggtcgacgacccgaacggcccaacccgactacggcctacgtccgtaccg

SEQ ID NO: 18572 - DNA, 602 bp, Homo sapiens
  misc_feature: GYAE6OF02IBGIW.14.70.G04.1.454.CMB.1.raw
  modified_base (391)..(391): a, c, t, g, unknown or other
  misc_feature (391)..(391): n is a, c, g, or t
tcagcgtctagtaccacgaccggtgctcgatttagtgtagtgtgaagggaaagggagggcagttggtagatgcccctctgggagagatccccagggtgacagccatggaccctggaagggcctgggctagggacagggaccagagccagtccagggagaggacagagccagtggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctggtcccaggcagcgctggcccctgcctgctcgctgggtctcggccatcgggtccnccgagtcggcctgcgtcgccgccgtaagtcggttacgcaccgcgaacggccgggaacccacggacccgtggacgtcctacgtacggtcggaagtccgagcccgactcccgacgccgtacggcgtacgccggtaggcggggtcaccgggtcgacggtaccccgaaacggccccaaccccgtaccgtccgtaccctaccgttcttacccccgg

SEQ ID NO: 18573 - DNA, 576 bp, Homo sapiens
  misc_feature: GYAE6OF02HSN1Q.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatcgctgcaagtcgggccagaggtgcccctgaacctgaacggccaatgagacccaagacaggccaagtggtgtgagacccctgaggagctggccctggtcccaggcagcgctcggcccctgctgctgctggtctggccagtcggtcgcccgagtcgcctgcctgccgcccaagtggtcgccaccgacgaaacgccgggacccagacccgtggacgcctcgaggttcggaagtccgacgccgactcccgagccctggcggacgccgtggtacggggctacggtcgaacggcccgaaacggccccaaccccgtctaccggtcctaccgtccgtacccg

SEQ ID NO: 18574 - DNA, 580 bp, Homo sapiens
  misc_feature: GYAE6OF02IBGUD.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatcgaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctggtcccaggcagcgctggcccctgctgctgctgggtctggccagtggcgcccatcggcctgctcgccgcccaagtcggttcgctaccgcgaaacggccggggaacccacggacccgtggacgccctcgacggttcggaacgcacggccgacgtcccagcccgtgccggacgccgtggtcggggcacgggtcacggcccgaacggcccaaccccgtacgtcgtacccgtacctcccgtacccg

SEQ ID NO: 18575 - DNA, 590 bp, Homo sapiens
  misc_feature: GYAE6OF02GMCDI.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggcctggtcccaggcagcgctggccctgctgctgctgggtctggccagtcggtcgcccgatcggcctgctgccgcccgaatcggttcgccgaccgcgaaacggcggggaacccacggacccgtgggacgcctcgacgttggaacgcgacggccgagtcccgaagtcccgtgccggacgccgtggtcggggccgagggtccgacggaccccgaacggtccccaaccccgtaccgtaccggtaccaccttccgttaccccgg

SEQ ID NO: 18576 - DNA, 562 bp, Homo sapiens
  misc_feature: GYAE6OF02FWEAW.14.70.G04.1.454.CMB.1.raw
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaagtcggccagaggtgcccctgaacctgaaggccaatgagaccaagacaggccaagtgggtntgagacccctgaggagcgtgggccctggtcccaggcagcgctggccctgctgctgctgggtctggaaccngtcggtcgcccagtcggctgctcgcgccatcggtgcacgcgaacgccgggacccaggacccgtggacgcctacgacgttaggaacgtcgacgcccgattcccgagcccgtgccggagtccgtggtcgggctacgggtccacggacccaacggcccaacccgtacgtcgtccacctcgtacccg

SEQ ID NO: 18577 - DNA, 612 bp, Homo sapiens
  misc_feature: GYAE6OF02HEMON.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccatcggcctgctgcgcccaatggtcgcaccgcaaacggcgggacccacggacccgtggacgcctacgacggttcgggaacgtccgacggcccgacgtcccgaacggtccctcgggccggacggcccgttagggtcggggggcaacggggttccgaacgggaccccgaaacgggcccccaaaccccgtaccgttaccggtacccgtaccgttcccttaccccgg

SEQ ID NO: 18578 - DNA, 591 bp, Homo sapiens
  misc_feature: GYAE6OF02F8JFI.14.70.G04.1.454.CMB.1.raw
  modified_base (238)..(238): a, c, t, g, unknown or other
  misc_feature (238)..(238): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggancccatgctgcaagtcgggccagaggtgcccctgaacctgaaggccaatgagacccaagacaggccaagtggttgtgagacccctgaggagctgggccctggtcccaggcagcgctggcccctgctcgctgctgggtctggccagtcggtcgccagtcggcctggctcgccgcctaagtcggtgccgtacgcgaaacggccgggacccacggacccgtggacgcccgtacgacggttcggaacgccgaaggcccgaagtcccgagcccgtggccggacgccgtgggtacgggacgtacgggtccaacggcccgaacggcccaacccgaccgttcgaccctacgtccttacccgg

SEQ ID NO: 18579 - DNA, 679 bp, Homo sapiens
  misc_feature: GYAE6OF02GPDQ1.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgcgtgctgcgtggtcgtggccagtcggtccgcccgactgggccctggcctcggccggtccccgtaacgttcgggttcgccgacccggaccgaaacgggaccgggggaaccccgacggaaccccgtacgggaccggcccgttaccgacgggtttacgggaaacggccgtaacggcccggaacgttcccgaacggtcccgttacggccgggacggtcccggtacgggtcgggggtccgacggggttaccgaccgggtaccccgaacgggacccctaaacccccggaccgttaccggtacccgtacccgtccgttacccccgg

SEQ ID NO: 18580 - DNA, 575 bp, Homo sapiens
  misc_feature: GYAE6OF02F2V03.14.70.G04.1.454.CMB.1.raw
  modified_base (374)..(374): a, c, t, g, unknown or other
  misc_feature (374)..(374): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaagccaatgagacccaagacaggccaagtgggttgtgagacccctgaggagctgggccctggtcccaggcagcgctggccctgctgctgctgggtcnggccagtcggtccgccactggcctggctcgcgcccagtcggtcgcaccgcgaaacgccggggacccaggacccgtggacgcctcgacggttggaagcgacgccgactcccgagccctggccgacgccgtggtcggggccaggggtcccaagggccccgaacggcccgaaaccccgccgtacgtcccacttcccgttcccgg

SEQ ID NO: 18581 - DNA, 571 bp, Homo sapiens
  misc_feature: GYAE6OF02FYZPA.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctggaggagctgggccctggtcccaggcagcgctggccctgctgctgctggtctggccagtggtcgcccgatggcctgctgccgccatggtcgcaccgcaaggccgggaccacgacctggacgctcgagttggaagcgagccgactccgagccgtgccgggacgccgtagggtcggggcgaagggttccgaacggtccccgaaacgggccccgaaaccccgtacgtccgtaccaccgttcgttacccccgg

SEQ ID NO: 18582 - DNA, 603 bp, Homo sapiens
  misc_feature: GYAE6OF02JG08C.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagcgtgggccctggtcccaggcagcgctggcccctgctgctggctgggtctggccagtcggtccgcccagtcggccgtgcgtcggccgccccgtaagtcggttgccgaccgacgaaacggccggggacccacggaccccgtgggacgcccgtcgacgttacggaacgccgacggccgacgtcccgacgccgtacggcggacgccgtagggtcgggcgacggtccgacggacccggaacggaccccgaacccaccgtcgtacctaccgtccgtcccgg

SEQ ID NO: 18583 - DNA, 614 bp, Homo sapiens
  misc_feature: GYAE6OF02FFW1I.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggacggtgcccctgaacctgaaggccaatgagacccaagacaggccaagtggttgtgagacccctgaggagctgggccctggtcccaggccagcgctggcccctgctgctgctgggtctggccagtcggtcgcccgatcggccctgcctcggccgccccgaaagttcgggttcgccgaacccggcgaaaacggccgggggaaccccaggacccctagggacgcccgtcgaggttcgggaacggtccaacggcccgaagtcccgaagtcccgtggcccggagtcccgtggtcggggccagggtccgaacggccccgaaggccccaaccccgactcgtccaccttccgttacccgg

SEQ ID NO: 18584 - DNA, 594 bp, Homo sapiens
  misc_feature: GYAE6OF02GJCQ7.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggacaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccagtcggtccgcccgagtcggcctgccgtggccgccccgaaagttcgggttcgccgtacccggcgaaaacggccggggaacccacggaccccgtggacgccgtcgaggttggaacggccggccgagtccgagcccgtgccggagccgtggtcggggcgagggtccacggcccgaacggcccaaccccgctcggtaccacgttccgtcgttcccccg

SEQ ID NO: 18585 - DNA, 529 bp, Homo sapiens
  misc_feature: GYAE6OF02G5RNF.14.70.G04.1.454.CMB.1.raw
  modified_base (486)..(486): a, c, t, g, unknown or other
  misc_feature (486)..(486): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccggtcctccagggagcccatgctgcaagtcgggccagaggtgcccctgaacctgaaggccaatgagacccaagacaggccaagtggttgtgagacccctgaggagctgggccctggtcccaggcagcgctggccctgctgctgctgggtctggccatggtcgcccatcggcctgctgcgcccaatggttgcaccgcaaacgcgggacccagaccctggacgcctcagttggaagcgagccgatccagcctgcggagccgtgngggcaggtcaggccaaggaccaacccgacgtgtcactctaccg

SEQ ID NO: 18586 - DNA, 634 bp, Homo sapiens
  misc_feature: GYAE6OF02HU6VN.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtggttgtgagacccctgaggagctgggccctggtccccaggcagcgctggcccctgctgctgctgggtctggccagtcggtcgcccatcggcctgctcgcgcccaatggttgcaccgacgaaacgccggggaacccacgaccctggacgcccgtcgaggttcggaaacgtccgaacgcccggaatcccgaacggccctagggccgggtaacggccccgttagggtcggggggtaccgtaacggggttacccgaaccgggcccccggaaacgggacccccgaaacccccgaaccgttacccggtaccctacccgttcccgttacccccggg

SEQ ID NO: 18587 - DNA, 567 bp, Homo sapiens
  misc_feature: GYAE6OF02GVVUJ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagcgtgggccctggtcccaggcagcgctggccctgctgctgctgggtctggccatggtcgcccatcggcctgctgccgccaagtgtgcaccgcgaaagcgggacccagaccctggacgcctagagttggaacgtcgacgccgatccgagcctaggcggacgtccgtggtacggggcgacgggtccgacggcccgaacggaccccaaccccgacgtaccggtacctaccgtccttaccccgg

SEQ ID NO: 18588 - DNA, 674 bp, Homo sapiens
  misc_feature: GYAE6OF02GWRUN.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtcgcccctgaacctgaaggccaatgagacccaagacaggccaagtgggttgtgagacccctgaggagcgtcgggccctggtcccaggcaggccgctcggcccctgctgctgctgggtctggcctagtcggtcgcccagtcggccgtgccgtcgccgccctaagtggttcgccgtaccggaccgaaacggcccgggggaacccacgggaccccgtaggggaccgtcccgtacgtacgggttacgggaacggtaccgaacggacccgtacgtaccccgtaacggccccgttaggcccgggtaacggtcccgttaggggccgggggaccgtacggggtccgtaacccggaccccgtaaacgggaccccctaaccccggtaccgttaccggtaccctaccggttccttaacccccgg

SEQ ID NO: 18589 - DNA, 840 bp, Homo sapiens
  misc_feature: GYAE6OF02JBGEO.14.70.G04.1.454.CMB.1.raw
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagacgaccaagtggacgtggggtgtactagtaacacgccctgcgtggcgaggacggaccaggaccaccgtcctacgagggactcccatcgctgacgaacggtccgggccaggacggtcgacccctagaacctgaacggccaagtcgacgaacccaaaggaccgaacggtacccgaaggtcgggttacggttacggaacggacccccgttaggaacgggacggccgtcggggccccgtcgggtaccccgacgggaccgacggcggcccgtcgggccccctcggccgtcgtccgtcggccgttggggtcccgttacgggacccgtacgttcgggtcccgtccccgtaacggtcgggcccgttcggtacccgttcggcccggtaccccgtaaacggttccgggtttccggacccgaacccggtacccggaaaacccgggcccgggggaaccccgtaaccggtaacccccggttacggggacccgtaccccgttaccggtaaccgggtttacgggaaccggaccgtaaccgggcccggaacgttaccccgaccggtcccgtacgggccgggtaccgtaccggtcgggtcggggaaccgttacggaccggtaaccggaccccgaaaccgggacccctaaacccggaccgttaccgtaccgtaccgttcccgttaaccccgg

SEQ ID NO: 18590 - DNA, 589 bp, Homo sapiens
  misc_feature: GYAE6OF02FFXTW.14.70.G04.1.454.CMB.1.raw
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcgggccaggacggtcgcccctagaacctgaacggccaatcgaacgaacccaagacgacggaccaaggttggttgtacggacgaccctgaggacgcgtcgggtccctcggtccgaggcacgccgctcggcccctgcgtgctggcgtgggtcncgcagtcggcnccgagcgcctgcncgcgacctagtcggtacaccgaccgacgaacgccgggacacgaccgngcgctagagtcgagcacgtccgactccgactcgtcgcggacgtcgaggcggacgacgtaccgaacgacccgaaccggacccaccgacctcgtaccctccgttcccgttcccgg

SEQ ID NO: 18591 - DNA, 575 bp, Homo sapiens
  misc_feature: GYAE6OF02IJB7J.14.70.G04.1.454.CMB.1.raw
tcagcgtctagtaccacgaccggtgctcgatttagtgtagtgtgaaggggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaaatgagacccaagacaggccaaagtgggttgtgagacccctgaggagcgtgggccctggtcccaggcagcgctggcccctgctgctgctgggtctggccatggtcgcccgatcggcctgctgcgccaatggttgcaccgcaaacggccgggaacccacggacccgtcggacgccgtacacgttaggaacgccaagccgactacccgacgccgtcgcggaggcccgtggtcggggcgagggtccacggacccgaacggcccaaccccgactcggtaccaccgttccgtcccg

SEQ ID NO: 18592 - DNA, 536 bp, Homo sapiens
  misc_feature: GYAE6OF02I04B4.14.70.G04.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (500)..(501): a, c, t, g, unknown or other
  misc_feature (500)..(501): n is a, c, g, or t
  modified_base (503)..(504): a, c, t, g, unknown or other
  misc_feature (503)..(504): n is a, c, g, or t
  modified_base (509)..(509): a, c, t, g, unknown or other
  misc_feature (509)..(509): n is a, c, g, or t
  modified_base (512)..(536): a, c, t, g, unknown or other
  misc_feature (512)..(536): n is a, c, g, or t
tcagcgtctagtaccacgaccggtgctcgatttagtgtagtgtgaagggaaggggcgtggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaaagngatcgaacaggcccgtgggancccgttgactacnggggccagggaaccctaggtcatcggtactccgtcagccctcaccaagggcccagtcggtcttcccccgtaggccacccctcctcccaacgtacgccacctcgtcgggggccacctacgccggccctcgggcctcggcccgtcgggtccgaaacgggtaccttacgttcccgtaactacgggaaccgcgttcgaacggtccggggacttcgggacgaaacgggtcgacaacgtagcagcgnncnngtacncgnnnnnnnnnnnnnnnnnnnnnnnnn

SEQ ID NO: 18593 - DNA, 662 bp, Homo sapiens
  misc_feature: GYAE6OF02IIN6X.14.70.G04.1.454.CMB.1.raw
  modified_base (437)..(437): a, c, t, g, unknown or other
  misc_feature (437)..(437): n is a, c, g, or t
  modified_base (626)..(626): a, c, t, g, unknown or other
  misc_feature (626)..(626): n is a, c, g, or t
tcagcgtctagtaccacgaccggtgctcgatttagtgtagtgtgaagggaaaggggagggcagttggtagatgcccctctaggagagatcccaggggtgacagccatggaccctggaagggcctgggctagggacagggaccagagccagtccagggagaggacagagccaatggactggggtgtactgtaacagccctgctggcgaggagggaccagggcaccggtcctccgagggacgcccatgctgcaagtcgggccaggaggtcgcccctgaaccgtgaacggccaaatgaacgacccgaaagacaggaccaaaggtgggttagtgacgacccctaggaggagcgtcgggccctcggtcccgaggccgacggcgcgtcgggcccctggctgctcggcttgggtctcgggccagtcggtcgcccagtcggtccngcgtcgcgacccgtaagtcggttcgcgaccgcgaaaggccggggaacctacggacctgggacgtccgtacgagttacgggaacgtcgaacggccgtaacgtccgaacggcctacggccgggtaacggcccgtaggggtccgggggcgtacgggtacccacgggaccccgaaacgggaccccgaaccccncggttaaccggtccgtaaccggttccctttcccggg

SEQ ID NO: 18594 - DNA, 586 bp, Homo sapiens
  misc_feature: GYAE6OF02I9YH0.14.70.G04.1.454.CMB.1.raw
  modified_base (401)..(401): a, c, t, g, unknown or other
  misc_feature (401)..(401): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccagacggtcgcccctgaacctgaacggccaatgaacgaccaagacaggaccaaggtggttgtgacgacccgtggaggagcgtcgggccctcggtcccaggcagcgcgtcggccctgctgctgcgtggtctggcagtggcgccngtcggctcgccgtcgccgcctagtcgtcgccgacgacgaaacggccgggaccgacggacccgcggacgccgtcgaggtcgaacgcgacgccgacgtccagccgtggcgtacggcgtggcggggcacggtccgacggtacccgaacggcccctaacccgtacgtccgtccgtaccgtccgttcccg

SEQ ID NO: 18595 - DNA, 603 bp, Homo sapiens
  misc_feature: GYAE6OF02GIWQN.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctgggccctggtcccaggcagcgctggcccctgctgctgctgggtctgggccatcggtcgcccgagtcggcctgctgccgcccgaatcggttcgccaccggcgaaacgccggggaaccccaggacccgtggacgcctcgaggttcggaagcgacgtccgacgttaccgaacgtccctaggccggacggtccggtcggtcgggggtccgacgggttccgaacggtcccgaacgggacccaaccccgtacgtccggtactaccgtcccgttacccgg

SEQ ID NO: 18596 - DNA, 601 bp, Homo sapiens
  misc_feature: GYAE6OF02GSG8S.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagaccaagacaggccaagtggttgtgagaccctgaggagcgtgggccctggtcccgaggcagcgcgtcggccctgctgctgcgtgggtctggccagtcggtccgcccgagtcggcctcgcgtcggccgccgaagttcggtcgcgtaaccggacgaaacggccgggaacccacggacccgtgggacgcctcgacgttaggaacgcgacgccgactccgacggccgtgaccggacgtccggtggtcggggcacgggtccgaaccggacccgaaccggacccaacccgtaccgtccggtctaccgttccgttccccgg

SEQ ID NO: 18597 - DNA, 625 bp, Homo sapiens
  misc_feature: GYAE6OF02HEKK0.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatcgctgcaagtcgggccaggaggtcgcccctgaacctgaacggccaatgacgacccaagacaggaccaagtgggttgtgacgacccctgaggagcgtcgggccctggtcccgaggcacggcgcgtcggccctgcctgctgcgtgggtctcggccagtcggtccgcccgagtcggcctgccgtcggccgcccgtaagtcggttcgccgtaccgacgaaacggccggggaacccacggacccgtggaccgccgtcggaacgttagggaacgcgacgccgtacgccgagcccgtaggccggacgtccgtgggcgggcgacgggtccgaccggacccgaaccggaccccgaaccccgacgttaccgtacctaccgtcccgttacccg

SEQ ID NO: 18598 - DNA, 644 bp, Homo sapiens
  misc_feature: GYAE6OF02GVZF0.14.70.G04.1.454.CMB.1.raw
  modified_base (238)..(238): a, c, t, g, unknown or other
  misc_feature (238)..(238): n is a, c, g, or t
  modified_base (474)..(474): a, c, t, g, unknown or other
  misc_feature (474)..(474): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggancccatgctgcaagtcaggccagaggtgcccctgaacctgaaggccaatgagaccaagacaggccaagtggtgtgagacccctgaggagctcgggccctggtcccaggcagcgctcggccctgcctgctgcgtggtctggccagtcggtcgcccagtcggcctggcctcgcgaccccgaagttcggttacgcgaacccgcgaaaacggcccggggaacccgacggacccgtgggacnccgtacgtaggttacggaagtaccgacggaccgaaccgtacccaacggtcccgtacgggacccgggtacgtacccggtagggtcgggggaccgtacggggtaccgaccggtaccccgaaacgggcccccgaaaacccccgtaccgtacggtacccgtaccgttaccccgg

SEQ ID NO: 18599 - DNA, 577 bp, Homo sapiens
  misc_feature: GYAE6OF02FW6ZE.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggcctggtcccaggcagcgctggccctgctgctgctgggtctggccagtcggtccgcccagtcggcctgctcgccgcccaagtcggtcgccaccggcgaaacggcgggacccagacccgtggacgcctacgagttacggaacgcgacgccgactccgagcccgtggccggagccgtgggtcggggcgacgggtcgacggcccgaaccgggcccaaccccgacgtaccgtccaccgtccttccccgg

SEQ ID NO: 18600 - DNA, 649 bp, Homo sapiens
  misc_feature: GYAE6OF02H56VU.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtggagacccctgaggagctgggccctggtcccaggcagcgctggccctgctgctgctggtctggccagtcggtcgcccgagtcggcctgcgttcgccgtcccaagtcggttaaaacgccgtaaccggaccgaaaacgggccggggaaccccgaacggaccccgtcgggaacgtcccgtaccgaggtttacgggaaacggccgaaggcccgaacgtcccgaacgtcccgtcgggccgggacgcccgttacgggtcggggtccgaacgggtccaccggaccccgtaaaccgggcccctaaaccccgaccgttaccgtaccgtacccgttccttaccccgg

SEQ ID NO: 18601 - DNA, 670 bp, Homo sapiens
  misc_feature: GYAE6OF02JKNJ5.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaaggccaaatgaagacccaagacaggccaaagtgggttgtgagacccctgaggagctgggccctggtcccaggcagcgctggccctgctgctgctgggtctggccagtcggtaccgcccagtcggccctgctcgccgccctaagtcggttcgcctaccgcgaaacggccggggaacccacggaccccgtgggaccgtccgtacgacggttcgggaacgccgacgccggacttcccgaaggtcccgtacgggaccgggtacgtcccgtagggtccgggggtaccgtaacgggggttacccaaccgggtacccccgaaaacggggtccccccgaaaacccccggtaccggttaccggttaaccccgtaccggttccccggtttaacccccgggg

SEQ ID NO: 18602 - DNA, 605 bp, Homo sapiens
  misc_feature: GYAE6OF02IF1L7.14.70.G04.1.454.CMB.1.raw
  modified_base (374)..(374): a, c, t, g, unknown or other
  misc_feature (374)..(374): n is a, c, g, or t
  modified_base (536)..(536): a, c, t, g, unknown or other
  misc_feature (536)..(536): n is a, c, g, or t
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccggtcctccagggacgcccagtcgctgcaaagtcgggccagaggtcgcccctgaacctcgaaggccaaatgacgaccaagacgaggaccagtgggttgtgacgacccctggagacgctggccgtaggtcccgaggcaggcgcgtcggcccngcgtcgctcgctgggtctcggcctagtcggtccgcccgagtcggcctgcctcggccgacccgagtcggttcgcgtaccggcgtaaacggccgggaaccccaggacccgtacggacgtcctaccgtaggttacggaacgacgacgaccggactaccgacgccncggcgtaccgcgttcggcgggtcgacggtcgcgacccgacggccaacccgcgtcgaccacgtcgtcccg

SEQ ID NO: 18603 - DNA, 623 bp, Homo sapiens
  misc_feature: GYAE6OF02FF0K1.14.70.G04.1.454.CMB.1.raw
  modified_base (411)..(411): a, c, t, g, unknown or other
  misc_feature (411)..(411): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcgggccaggacggtcgcccctgaaccctgaaggccaaatgagacccaagacaggccaagtggtgtgagacccctgaggagcgtgggcctggtcccaggcagcgctcggcccctgctgctgcgtgggtctgaccagtcggtccgcccatcggcctgcncgccgccctaagtcggttcgaccaccggacgaaacggccggggaacccacggacccctgggacgtcccgtacgacggttacgggaacgccgacggcccgaactcccgacgccgtggccggtacgcccggtggtcggggaccgacgggtccaaccggccccgaaacggcccccaaccccgtaccgtcgtaccctacccgttccgttacccccg

SEQ ID NO: 18604 - DNA, 581 bp, Homo sapiens
  misc_feature: GYAE6OF02F2BOI.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagacccctgaggagctgggccctggtcccaggcagcgctggcccctgctgctgctggatctggccatcggcgcccgatggcctgctcgcgtcccgaagtggttgccaccgacgaaacggcgggaccccaggaccctgggacgtccgtacgaggttcggaacgtccgacggccgaatcccaaggccctaggcccggaggccgtcggtcggggccacgggtccacggccccgaacgggccccaaaccccgtctaccggtccaccgttcccg

SEQ ID NO: 18605 - DNA, 564 bp, Homo sapiens
  misc_feature: GYAE6OF02FRMO5.14.70.G04.1.454.CMB.1.raw
  modified_base (414)..(414): a, c, t, g, unknown or other
  misc_feature (414)..(414): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggacaccgtcctccagggacgcccatgctgcaagtcgggccagaggtcgcccctgaaccctgaaggccaatgagacccaagacaggccaagtggttgtgagacccctgaggagctgggccctggtcccaggcagcgctggccctgctgctgctgggtctggccagtggtcgcccatggcctgctgcgcccaatggtncaccgcaaacggcggggacccaggaccctggacgcctcaggttcggaagcgagcccgatcccgagcccgtgcggacgccgtggtcggggccagggtccaacggtccccgaagggccccaaccccgacgtcgtaccacctccgttaccccg

SEQ ID NO: 18606 - DNA, 685 bp, Homo sapiens
  misc_feature: GYAE6OF02JPXIA.14.70.G04.1.454.CMB.1.raw
  modified_base (266)..(266): a, c, t, g, unknown or other
  misc_feature (266)..(266): n is a, c, g, or t
tcagcgtctagtaccacgaccggtgctcgatttagtgtagtgtgaagggaaaggggagggcgagttggtagatgccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccagggagcccatcgctgcaagtccgggccagaggtcncccctgaacctgaacggccaaagtggaacgacccaagaccaggtccaaaggtggggttacgtgaacggacccctggaacggacgcgtggggcccctgggtccccagggccacggtccggccgtcggcccctggccgtcgtccgtggccgttcggggtcctacggccgtaagtcgggtccggcccagttccggcctgctcgcgtcccagtcggtcgcctacgcgaacggccgggacccacgacccgtcggacgtcctacggacggttacggaacgtccgaacgtccggaacttcccgacgttaccgcggtaccgggacgtcccggtagggtccggggtaccgacgggttaccgaccggacccgaaaccgggtcccgtaaaccccgacgttacccggtaccgtacccgtcccgttaacccg

SEQ ID NO: 18607 - DNA, 552 bp, Homo sapiens
  misc_feature: GYAE6OF02IUA5Q.14.70.G04.1.454.CMB.1.raw
  modified_base (237)..(237): a, c, t, g, unknown or other
  misc_feature (237)..(237): n is a, c, g, or t
  modified_base (410)..(410): a, c, t, g, unknown or other
  misc_feature (410)..(410): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagcgtgggccctggtcccaggcagcgctggccctgctgctgctggtctgccatcggtcgccatcggcctgctgcgccagtggtncacgcgaaacgccgggacccacggacccgtggacgcctacgagttacggaagcgagccgacgtccacgcctcggcggacgccgtggtcggggcacggtcgacggcccgaaggcccaacccgcgtcgacctactcctacccgg

SEQ ID NO: 18608 - DNA, 848 bp, Homo sapiens
  misc_feature: GYAE6OF02JL871.14.70.G04.1.454.CMB.1.raw
  modified_base (266)..(266): a, c, t, g, unknown or other
  misc_feature (266)..(266): n is a, c, g, or t
tcagcgtctagtaccacgaccggtgctcgatttagtgtagtgtgaagggaaagggagggcgagttggtagatgccctctggagagatcccagggtgacagccatggaccctggaagggcctgggctagggacagggaccagagccagtccagggagaggacagagccaatggactggggtgtacgtgtaacagccctgctggcagaggaccagggcaccggtcctccgagggagcccatggctgcaagtccgggccaggacggtcncccccgttgaacccgtgaacggccaaagtcggacgacccgaaaggacccgaaggacccgaaaggttcgggtttacggttacggacggtaaccccccgttaggaacgggaacggcccggtttaacggggccccccgttagggggtttccccccgaagggggtcccgtaaacgggtcccggccggttaccggggtaccccccgttcgggtacccgttcgggtcccgttcgggtcccggttaacgggggtttcccgttcggggtacccctaacggttccggggtacccggttccccgaacggtttccgggcccgtttcggcccgttcgggaccccgtaccccgtaaggttccggttcggacccgtacccggacgaaaccgggccggggaacccgtaccgggacccgtacggacgtccgtaccgtcggtacggtaacgccgaacgccgacgttaccgacggtacccgtgggaccggtacggccgttacggggtaccggggtccggtacggttcccggaaccggaccccggaacggacccccgaaccccgtaccgttcggaccctaccggtttccgttaacccccgg

SEQ ID NO: 18609 - DNA, 673 bp, Homo sapiens
  misc_feature: GYAE6OF02F5CH9.14.70.G04.1.454.CMB.1.raw
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacgcccatgctgcaagtcgggccagacggtgcccctgaacctgaaggccaatgagacccaagacaggccaagtgggttgtgagacccctgaggganccgtgggccctggtcccaggcagcgctggccctgcngctgctgggtctggcctagtcggtccgcccatcggccctgccgtcgccgcccgaagtcggttcgcctaccggccaaacggcccggggaacccacggaccccgtggaccgcccgtacgacggttcggaaggtcccgaaggtacccggacgtcccgaacggtcccgttacgggaccgggtaaccggcccggtcgggttaccggggggtcccgtaaggggttccccgaacgggacccccgtaaaaccgggcccccgaaaccccccggtaacgtacccgggttaccctacccgttcccgtttacccccggg

SEQ ID NO: 18610 - DNA, 620 bp, Homo sapiens
  misc_feature: GYAE6OF02IJ8FB.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacgcccatgctgcaagtcgggccagaggtgcccctgaacctgaaggccaatgagaacccaagacaggccaagtggttgtgagacccctgaggagcgtgggccctggtcccaggcagcgctcggccctgctcgctgcgtgggtctcggcctagtcggtcgcccgatcgggccttggccgtcgaccgtcccgaagttcgggttcgccgaccgacgtaaaacggccggggaacccacggacccgtggacgcccgtcgtaggttcggaacgtccgaaggcccgaagtcccgtacggcccgttaggaccggacgtccgtcgggtcggggcgacgggtccaacggacccgaacggcccaacccgaccgtccgtacctaccgtccttacccgg

SEQ ID NO: 18611 - DNA, 817 bp, Homo sapiens
  misc_feature: GYAE6OF02J02KP.14.70.G04.1.454.CMB.1.raw
  modified_base (793)..(793): a, c, t, g, unknown or other
  misc_feature (793)..(793): n is a, c, g, or t
tcagcgtctagtaccacgaccggtgctcgatttagtgtagtgtgaagggaaaggggagggcgagttggtagatgccctctgggagagatcccagggtgacagccatggaccctggaagggcctgggctagggacagggaccagagccagtccagggagaggacagagccaatggactggggtgtactgtaacagccctgctggcgagagggccagggcaccgtcctccgagggacgcccgatcggctggacgaacggtccgggacctagggacggtcgccccccgttgaacccgttggaaacggccccgaaagttcggaacggaaccctaaaagggaacccgaacggggtacccctaaaagggttcggggtttaggttacggaacggaaccccccgttagggaagggaacgggtccggttaccgggggcccccgttaggggttacccccgaaaggggtcccaacggggtcccgtaccggtccgggtcccccgttaggcccgttacggccgtttcggaccggtttcgggttccgttacgggccctaagtcgggttacccgcccgacgggttccggccgtttccggcgtttaccggcccggttccccgtaaacggttcgggtaccggtacccgtaacccggacgtaaacccggggcccggggaaccccgacggtaaccccgggttcggaaccgtccgtacgtacggtacggacgcggaaccgtccgacgtaccgacgccggtcgccggtacgcgttacggtgggcgacggtccgacggccgaacgcccgaacccnccgtcggtaccacgttcctcccgg

SEQ ID NO: 18612 - DNA, 599 bp, Homo sapiens
  misc_feature: GYAE6OF02HR7CK.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaaggccaatgagacccaagacaggccaagtgggttgtgagacccctggaggagctgggccctggtcccaggcagcgctggcccctgctgctgctgggtctggccagtcggtcgcccgagtcggcctgctcgccgccgtaagtcggttgccaccgacgaaacggccgggacccacggacccgtcgggacgcctcgaggttcggaacgtcgacggcccgtacgtccgacggcctcggcggacgccgtggtcggggcgtacggtacgacggacccgaacggaccccgaaccccgccgtaccggtacctaccgttccttacccgg

SEQ ID NO: 18613 - DNA, 565 bp, Homo sapiens
  misc_feature: GYAE6OF02GPE6D.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctggcccctgctgctgctgggtctggccagtcggtcgcccagtcggcctgctgcgcccagtcggtgcaccgcgaaacgcggggacccacggacccgtggacgcctcgacggttcggaagccgacgccgatcccagccgtgcggagccgtggcggggcacgggtccaacggcccgaaggacccctaacccgacgtcgtacctaccgtcttacccgg

SEQ ID NO: 18614 - DNA, 587 bp, Homo sapiens
  misc_feature: GYAE6OF02H1CBF.14.70.G04.1.454.CMB.1.raw
  modified_base (264)..(264): a, c, t, g, unknown or other
  misc_feature (264)..(264): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggacaccgtcctccagggagcccatgctgcaagtcgggccagaggtncccctgaacctgaaggccaatgagacccaagacaggccaagtgggttgtgagacccctgaggagctgggccctggtcccaggcagcgctgccctgctgctgctggtctggcagtggcgccatcggctgctcgcgcccaagtcggttcgccaccgcgaaacggccggggaacccagacccgtggacgcctacgaggttacggaaacgccgtacgaccgactcccgagtcccgtgaccggtacgccgttggtcggggctacgggtccaacggtaccccgaacggacccaaccccgtacgtaccgtaccctaccgtccttacccgg

SEQ ID NO: 18615 - DNA, 578 bp, Homo sapiens
  misc_feature: GYAE6OF02GXFVI.14.70.G04.1.454.CMB.1.raw
  modified_base (311)..(311): a, c, t, g, unknown or other
  misc_feature (311)..(311): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtgggttntgagacccctgaggagctgggccctggtcccaggcagcgctcggccctgctgctgctggctggccagtcggtcgcccagtcggcctgctgccgccctaagtcggttcgcgtaccgacgaaacggccgggaacccacggaccctggacgcctcgacgttcggaagcgacgccgacgtccacgccgtgccggacgtcccgtggtcggggcacgggtcacggacccgaacggaccccaacccggacctccgacctaccgtccttaccccg

SEQ ID NO: 18616 - DNA, 734 bp, Homo sapiens
  misc_feature: GYAE6OF02JS6TH.14.70.G04.1.454.CMB.1.raw
  modified_base (265)..(265): a, c, t, g, unknown or other
  misc_feature (265)..(265): n is a, c, g, or t
  modified_base (560)..(560): a, c, t, g, unknown or other
  misc_feature (560)..(560): n is a, c, g, or t
tcagcgtctagtaccacgaccggtgctcgatttagtgtagtgtgaagggaaagggagggcgagttggtagatgccctctgggagagatcccaggggtgacagccatggaccctggaagggcctgggctagggacagggaccagagccaggtccagggagaggacagagccaagtggacgtggggtgtacctagtaacagccctagccgtggcgaggacggaccgagggtcaccggtcctaccgaggggacgcccgtaagtcggcncgacgaaggtccgggggaccagggaggttcgccccctagaaccgtggaacggccaagtgacgacccgaaagacgacggtaccgaacggtgggttgtagaccggaccccttggaacggtacggcggtcgggaccgttcggtcccgaaggcgtacggccggtacgtcggccctggctggccgtggcgtggggttacctgggccctaggtccggtccgccgcggtcggtcccgtgccgtacggccgtaccgtaattcgggttacgccgtaaccggacgtaaaccgggcggaacccggngtaacccgcgggaacgtccgtacgacggttacggagtccgaggccgtacgccgaacggtcctacggcggtaccggtcttcggggacgggtacgtccgggtacaaccgggtaacccacgggtacccccgaacccggtacgttaccggaaccgttcccggttacgttacccccggg

SEQ ID NO: 18617 - DNA, 633 bp, Homo sapiens
  misc_feature: GYAE6OF02IOKYS.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggaagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtgcccctgaacctgaaggccaatgagaccaagacaggccaagtgggttgtgacgaccctggaggagcgtgggccctggtcccaggcagcgctcggcccctgctgctgcgtgggtctggccagtcggtcgcccgagtcggcctggcgtcggccgtccctaagtcggttcgccgaccggacgaaacgggcccggggaacccacggaccccgtagggaccgtcccgtacgaacggttcgggaacgccgaacggccgaactcccgacgtcccgtggccggacgccggtgggtcggggcgacgggtccgacggaccccgaaccggaccccaaccccgaccgtaccgtacccgtaccgttcccgtaccgttccccccg

SEQ ID NO: 18618 - DNA, 584 bp, Homo sapiens
  misc_feature: GYAE6OF02HDHDG.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgagacccaagacaggccaagtgggttgtgagacccctgaggagcgtgggccctggtcccaggcagcgctcggcccctgctgctgctgggtctggccagtcggtcgcccgatcggcctgctggccgcccaagttcggttcgccgaccgacgaaacggccggggaacccacggacccgtggacgcctcgagttggaacgcgacgccgatcccgagcccgtgccggagccgtggcggggctacggacgaacgaccccgaacggtccccaacccgtacgtccgtcctaccgtcgttaccccg

SEQ ID NO: 18619 - DNA, 572 bp, Homo sapiens
  misc_feature: GYAE6OF02GFUD6.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggttgtgagacccctgaggagctgggccctggtcccaggcagcgctgcccgtgctgctgctgggtctggccagtcggtcgcccatcggcctgctgcgcccaagtcggttcgcaccggcaaacggccggggaacccacggaccctgggacgcctcgacggttcggaagcgacggccgacgtcccagccgtggcggacgccgtggtcggggcagggtccacggccccgaacgggcccaacccgacgtccgacctacctccgttacccg

SEQ ID NO: 18620 - DNA, 557 bp, Homo sapiens
  misc_feature: GYAE6OF02F9A0S.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccgatcggcctgcctgccgcccaatcggttcgcaccgcgaaacggccgggacccacggaccctggacgcctcgaggttcggaagcgacgccgatccacgcctgccggagccgtggtcggggcaggtcgacggtcccgaaggcccaacccgacgtcgcctactctcccgg

SEQ ID NO: 18621 - DNA, 591 bp, Homo sapiens
  misc_feature: GYAE6OF02H02SN.14.70.G04.1.454.CMB.1.raw
  modified_base (401)..(401): a, c, t, g, unknown or other
  misc_feature (401)..(401): n is a, c, g, or t
tcagcgtctagtaccacgaccggtgctcgattttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtgcccctgaacctgaaggccaatgagacccaagacaggccaagtgggttgtgagacccctggaggagctgggccctggtcccaggcagcgctggcccctgctgctgctggtctggcagtcggtcgccatcggctgcngcgcccagtcggtgcaccgcgaaaggccgggacccagacccgtggacgcctacgaggttacggaacgcgacggtccgactaccgacgccgtgaccggtacgtcccgtgggtacggggcgtacgggtacgacgtaccccgtaaacgggaccccaaccccgtaccgtaccgtacctacccttcgttaccccg

SEQ ID NO: 18622 - DNA, 618 bp, Homo sapiens
  misc_feature: GYAE6OF02IMBT9.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaaatgagacccaagacaggccaagtgggttgtgagaccccgtgaggagcgtgggccctggtcccgaggcagcgctcggcccctgctgctgctggtctggcagtcggtcgcccgagtcggcctgctcgccgcccaagtcggttcgccgaccgacgaaacggccggggacccgacggacccgtcggacgccgtacgaggttggaacgcgacgccgacgtcccgagccgtacggccggacgtccgtacgggtcggggccgacgggtccgaacggaccccgaaacgggtccccgaaaccccgtaccgttaccggtacccgtaccgttcccgttaccccgg

SEQ ID NO: 18623 - DNA, 626 bp, Homo sapiens
  misc_feature: GYAE6OF02I2VEP.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatcgctgcaagtcgggccaggaggtgcccctgaacctgaacggccaatgagacccaagacaggccaagtcgggttgtggacgacccgtgacggacgcgtgggccctggtcccgaggcacgcgctcggccctgctgctggctcgggtctaggcagtcggtccgccagtcggcctgctcgcgcccgagtcggtcgcgacgcgaacgcgggaccacgccgtggacgcctcgaggtcggaacgcgacgaccgacgtccgacgtcctaggccggacgtccggtaggttaccggggccgtacgggtaccgaaccgggaccccgaaccgggtacccctaaccccggtaccgttacccggtttaacccgttccgttacccggttaccccccgg

SEQ ID NO: 18624 - DNA, 651 bp, Homo sapiens
  misc_feature: GYAE6OF02IFZV5.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaaggtcgggcagaggtcgcccctagaacctgaaggccaatgagacccaagacaggccaagtgggttgtgagacccctgaggagctgggccctggtcccaggcagcgctcggccctgctgctgctggtctggccatcggtcgcccagtcggcctgcgtcgccgccagttggttcgccaccgcgaaacggccggggaaccccacggacccgtacgggacgcccgtacgtaggttacggaacgtccgaaacggcccgaagttcccgacggtcccgtacggccgggaacgtccggttcgggtacgggggccgaaccggggttccgaacccgggtaccccgaaaccgggacccccgaaacccccgtaccgttaacccggttaccctacccgttcccgttacccccgg

SEQ ID NO: 18625 - DNA, 576 bp, Homo sapiens
  misc_feature: GYAE6OF02FH3AT.14.70.G04.1.454.CMB.1.raw
  modified_base (353)..(353): a, c, t, g, unknown or other
  misc_feature (353)..(353): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaaccctgaaggccaatgagacccaagacaggccaagtggttgtgagacccctgaggagctgggccctggtcccaggcagcgcnggccctgctgctgctgggtctggccatcggtcgcccatggcctgctcgcgcccaatggttgccgaccgacgaaacggccggggacccaggaccctgggacgcctcgaggttggaacgccagccgagtccagcccgtgccggtagcccgtggtcgggggctagggtccgaacggccccgtaaacggcccgaacccccgactcggtccaccgttccgttacccgg

SEQ ID NO: 18626 - DNA, 667 bp, Homo sapiens
  misc_feature: GYAE6OF02HX0CE.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggagcccatgctgcaagtcgggcaggaggtgcccctgaacctgaaggccaatgagaccaagacaggccaagtggtgtgagacccctgaggagcgtggcccctggtcccaggcagcgctcggccctgctcgctgcgtgggtctcggcctagtcggtcgcccctagtcggcctggcctggcccgccctaagttcgggttacgccgtaccggaccgaaacgggcccggggaacccacggacccgtgggaacgtcccgtaccgtaggttacggaacggtccgacggcccgaacgtcccgtacgggccctagggtccgggacgttcccgggtagggtccgggggtacggtaccgggttccgaaccggtacccccgaacgggtacccccaaaccccggtaccgttaccggtacccgtacccgttcccgtttacccccgg

SEQ ID NO: 18627 - DNA, 593 bp, Homo sapiens
  misc_feature: GYAE6OF02H26RB.14.70.G04.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcgggcagaggtgcccctgaacctgaaggccaatgagaccaagacaggccaagtgggttgngagacccctgaggagctgggccctggtcccaggcagcgctggccctgctgctgctgggctggccagtcggtcgccagtcgcctgctcgccgccagtcggtcgcaccgcgaaacggccgggaacccacggacccgtgggacgccgtacgacggttacggaacggccacgcccgactacccgaggcctcggcggacgccgtggtcggggctaacgggtccaacggccccgtaaagggccccaaacccccgtacgtacccggtacctaccgttaccttccccgg

SEQ ID NO: 18628 - DNA, 591 bp, Homo sapiens
  misc_feature: GYAE6OF02ILGMQ.14.70.G04.1.454.CMB.1.raw
  modified_base (313)..(313): a, c, t, g, unknown or other
  misc_feature (313)..(313): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggttngacgacccctggaggagcgtcgggccctggtcccaggcagcgctggccctgctgctcgctgggtctggccagtcggtcgcccagtcggcctgcgtcgccgcccaagttcggttcgccgaccgacgaaacggccgggaacccacggacccgtggaccgcctacgaggttacggaacgccgacgccgtactccgaacgccgtacggcggacgccgtggtcgggcgacgggtcacgacccgaacggacccaacccgacgtaccgtctacctcgttacccgg

SEQ ID NO: 18629 - DNA, 615 bp, Homo sapiens
  misc_feature: GYAE6OF02F8ZS4.14.70.G04.1.454.CMB.1.raw
  modified_base (379)..(379): a, c, t, g, unknown or other
  misc_feature (379)..(379): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggaggtcgcccctagaacctgaaggccaatgagaccaagacaggccaagtggtgtgagacccctgaggagcgtgggccctggtcccaggcagcgctggcccctgctgctgctgggtcnggccagtcggtcgccctagtcggccctgctcgccgcccaagtcggttcgcaccggcgaaacgggccggggaaccccgacggtaaccccgtcggacgtcccgtcgtacggttacgggaacggcgacggtacccgactacccgacgccgtcggaccggtacgccgttggcggggcgacgggtccgacggtacccgacggaccccaaccccgacgtccgtcctaccgtacttaccccgg

SEQ ID NO: 18630 - DNA, 648 bp, Homo sapiens
  misc_feature: GYAE6OF02G1I45.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgccaaggtcgggccagaggtcgcccctgaacctgaaggccaatgagaccaagacaggccaagtggttgtgagacccctgaggagcgtggccctggtcccaggcaggcgcgtcggccctgctgctgcgtggtctggctagtcggtccgcccagtcggcctgtccgtcgccgaccctaagttcgggttcgccgacccggacgaaaccgggccggggaaccccgacggtaccccgtgggacgccgtacgtacggttacgggaacgtcgacggcccgacgtcccgaacggccgtacggccggtacgcccggttgggtaccgggggcgtacgggtaccgaccggtaccccgaaccgggaccccaaccccgtaccgtaccggtaccgtaccgttccgttacccccgg

SEQ ID NO: 18631 - DNA, 633 bp, Homo sapiens
  misc_feature: GYAE6OF02G6IWF.14.70.G04.1.454.CMB.1.raw
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccaggaggtcncccctgaacctgaaggccaatgagaccaagacaggccaagtgggttgtggacgacccctgaggagcgtgggccctggtcccaggcagcgctcggccctgctgctggctgggtctcggccagtcggtccgcccgagtcggcctggctcggcgccctaagtcggttgccgaccgacgaaacggccggggaacccacggacccgtggacgcctagacggttcggaacgcgacgccgtactaccgacggcctacgggccggacgccgttcggggtacggggccggtaacggtcccggaacggaccccggtaaacgggcccccaaacccccggtccgttaccggtacccgttacccgttccgttacccccgg

SEQ ID NO: 18632 - DNA, 617 bp, Homo sapiens
  misc_feature: GYAE6OF02GOB2W.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaggccaatgagaccaagacaggccaaggtggttgtgagaccccgtgaggacgcgtgggccctgggtcccaggcagcgcgtcggcccctgcctgctgctggtcgtcggccagtcggtcgcccgagtcggcctcggctcggcgccctaagtcggtcgcgaaccgcgaaacggcggggaacccacggacccgtagggaccgccgtacgtacgttacgggaacgcgacggccgtaacgtccgaacgccgtaggccggacgtccggtggtcgggcgacgggttccgaaccggacccgaacggaccccaacccgaccgtccggtaccctaccgttccttacccccgg

SEQ ID NO: 18633 - DNA, 666 bp, Homo sapiens
  misc_feature: GYAE6OF02I9UQ8.14.70.G04.1.454.CMB.1.raw
  modified_base (261)..(261): a, c, t, g, unknown or other
  misc_feature (261)..(261): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagnggtgcccctgaacctgaaggccaatgagacccaagacaggccaagtgggttgtgacgacccctgaggagctgggccctggtcccaggcagcgcgtggcccctgctgctgctgggtctggccagtcggtccgcccgagttcggccctgccgtcgccgcccgtaacgttcgggttcgccgtaccggaccgaaacggcccggggaacccgaaccggaccccgttacgggaaccgtcccgtacgtaacggtttcggaacggccgaacggcccgaacgtaccccgaacgccccggttcggccgggaacggtcccggttagggtccgggggccgtacggggtcccgtaacgggaccccgaacgggaccccaaccccgtaccgttccgtacctacccgtcccgttcccccgg

SEQ ID NO: 18634 - DNA, 626 bp, Homo sapiens
  misc_feature: GYAE6OF02I5L9V.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggccaagtgggttgtgagacccctgaggagctgggccctggtcccaggcagcgctggccctgctgctgctgggtctggccagtcggtcgcccagtcggcctgctgccgcccgtaagtcggttcgccgtaccggacgaaacggccggggaacccacggacccgtgggacgcccgtcgacgttcggaacgtcgaacgccgacgtcccacggacctcggccggaacgtcccgtcgggtcgggggtaccacgggttaccgaacggtaccccgaaacgggtacccccaaccccggtacccgttaccggtaccctaacccgttcccgttaccccg

SEQ ID NO: 18635 - DNA, 556 bp, Homo sapiens
  misc_feature: GYAE6OF02FZLPA.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaagtggtgcaccgcaaacgcggggacccagacccgtggacgcctcgagttacggaagcgagccgacgtccagccctgccggagccgtggtcggggcgacgggtcacggcccaaggcccaaccccgaccgtacggtcctaccgtccttacccg

SEQ ID NO: 18636 - DNA, 640 bp, Homo sapiens
  misc_feature: GYAE6OF02FW9QI.14.70.G04.1.454.CMB.1.raw
  modified_base (485)..(485): a, c, t, g, unknown or other
  misc_feature (485)..(485): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggacggtcgcccctgaaccctgaaacggccaaatgaacgaacccaagacaggccaaggtgggttgtggacgaccccgtggaggacgcgtcgggccctggtcccgaggcaggcgctcggccctgctgctgcgtggtctcggcagtcggcgccagtcgcctcgcctcgccgcccgtaagttcggtcgaccgaccggaccgaaacggccgggaacccacggacccgnggaccgcctacgacggttacggaacgtccgacgcccgtactccgacgccggtacgcgggacgtccggttgggcggggtacgacgggtcccgtaaccgaccccggaacggaccccgaaccccgtacggttcccgtaccgtacccttcgtacccccg

SEQ ID NO: 18637 - DNA, 559 bp, Homo sapiens
  misc_feature: GYAE6OF02H2W5Y.14.70.G04.1.454.CMB.1.raw
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccagtcggtcgcccactggcctgctgccgcccaagtggttgcaccgcgaaagcgggacccagccctgggacnccncgtagtggaagcgagccgatccagcctgccgagccgtggtcggggcacggtccaggaccccgaacggccccaaaccccgcgttacgtaccctacgttccttaccccgg

SEQ ID NO: 18638 - DNA, 700 bp, Homo sapiens
  misc_feature: GYAE6OF02GCJ42.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacgcccatgctgacgaagtcggccaggacggtcgcccctgaaccgtgaacggacaagtgaacgaccaagacaggccaaggtggttgtgacgccccgtggaggcgacgtcggcccgtcggtcccgaggcgagccgcgtccggccccgtgcgtcgcgtcgcgtggtcgtcggcctagtcggtccgccgtacgtcggtccgtggccgtcgcccgtacccgaaggttcgggttacgaccgtacccgaccgaaaccgggtccggggaaacccgaccggaccccgtacgggaccgtcccgtacggtacgggttacggaacggtccgaccggtacccggacttacccgacgtacccggtacgggccggacggtcccgtggggtacggggtaccgtacgggtccgaaccggaccccgaacggtaccccgaaccccgtaccgttaccgtaccgttacccgtccgtttacccccgg

SEQ ID NO: 18639 - DNA, 590 bp, Homo sapiens
  misc_feature: GYAE6OF02FYONM.14.70.G04.1.454.CMB.1.raw
  modified_base (514)..(514): a, c, t, g, unknown or other
  misc_feature (514)..(514): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccagaggtcgcccctgaacctgaaggccaaatgaacgacccaagacaggccaagtgggttgtgacggacccctgaggagcgtgggccctggtcccaggcagcgctggccctgctgctgcgtgggtctggccagtcggtcgcccatcgggcctgcctcgccgccctagtcggttcgcgaccgcgaaacggccgggaacccacggaccctgggacgccctacgacggttcggaacgccgacgccgactcccgacgccgnggcggacgccgtggcggggtcagggtcacggtacccgaacggcccaaccccgcgtcgaccctaccgtccttcccgg

SEQ ID NO: 18640 - DNA, 651 bp, Homo sapiens
  misc_feature: GYAE6OF02GWIGW.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggagcccatgctgcaagtcgggccaggaggtcgcccctgaacctgaacggccaaatgagacccaagacaggccaagtgggttgtggacgaccccgtgaggagcgtgggcccctgggtcccaggcagccgcgtcggcccctgctgctgcgtgggtctggcctagtcgggtccgccgagtcggcctgtccgtcgcccgacccgtaagttcggttcgaccgaccggtaccgaaacggtccggggaaccctaccggacccgtaggacccgccgttacgacggttacggaagccgacgcccgaatcccgacgtcctcggccgggacgtcccggtgggtcgggggacctacggggtaccgtacggacccggaacggacccccgaaccctacggtccgtaccgtacccgttcccgttaccccgg

SEQ ID NO: 18641 - DNA, 561 bp, Homo sapiens
  misc_feature: GYAE6OF02FRWAX.14.70.G04.1.454.CMB.1.raw
  modified_base (185)..(185): a, c, t, g, unknown or other
  misc_feature (185)..(185): n is a, c, g, or t
  modified_base (505)..(505): a, c, t, g, unknown or other
  misc_feature (505)..(505): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccaggggcaccgtcctccgagggacgcccatgctgcaagtcgggccagaggtgcccctgaacctgaaggccaatgagacccaagacaggccaagtggttgtgagacccctgaggagctgggccctggtcccaggcagcgctggcccctgctgctgctgggctgaccatggtcgcccagtcggcctgctcggccgcccaagtggttcgccaccgcgaaaacggccggggacccagacccgtcggacgcctcgagtggaagcgagccgatccgagccgtgcggacgcgtaggnggggcagggtccacgacccgaacggcccgaaccccacgcgtcctacctcttacccg

SEQ ID NO: 18642 - DNA, 617 bp, Homo sapiens
  misc_feature: GYAE6OF02GHCIN.14.70.G04.1.454.CMB.1.raw
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
  modified_base (514)..(514): a, c, t, g, unknown or other
  misc_feature (514)..(514): n is a, c, g, or t
tcagcgtctagtaccacgaccggtgctcgatttagtgtagtgtgaagggaaagggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgccaaggtcgggccaggaggtcgcccctgaacctgaacggccaatgacgaccaagacaggccaagtggttgtgacgacccctgaggagcgtgggcctcggtccaggcagcgcnggcccctgctgctgctggtctggccagtcggtcgcccgagtcggcctggctcgccgcctaagtggttcncgaccgcgaaacggccgggacccgacggacccgtcgggacgcctacgaggttcggaagccgacgccgtacgtccgacgtcccgngggacggacgccgtgggtacggggcggtagggttaccgaacggacccgtaacggaccccgaaccccggtaccgttccgtaccctaccgtcccgttacccccgg

SEQ ID NO: 18643 - DNA, 746 bp, Homo sapiens
  misc_feature: GYAE6OF02IL9XR.14.70.G04.1.454.CMB.1.raw
  modified_base (332)..(332): a, c, t, g, unknown or other
  misc_feature (332)..(332): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggcaccgtcctccgagggacgccatgctgcaagtcgggaccaggaggtcgcccctagaaccctggaacggccaagtggaacgaacccgaagacacggaccgaaggtcgggttnaggacgtaccccgtggaggacgcgtacgggccctggtcccaggtccagccggcgtcggcccgtcgctacgcgtcggccgttgggtctcgggccgtatccgggtccacccgtagtcggcccgtgccgttcggaccgacccgtaacggttcggttaccgccggtaacccggacgaaacgggcccggggtaaccccgtacggtacccgtacgggaactcccggtaacggtacgggttaccgggaacgccggtaccggtacccggtaacctaccgaaccggtccggtaaccggggacgaccccgggtaccgttacggggtaccggggacccaccggggttaccaaccgggtaccccgaaaccggggacccctaacccgtacggttacccgttacctaccccgttacccgttaccccgg

SEQ ID NO: 18644 - DNA, 820 bp, Homo sapiens
  misc_feature: GYAE6OF02JYU4B.14.70.G04.1.454.CMB.1.raw
  modified_base (182)..(182): a, c, t, g, unknown or other
  misc_feature (182)..(182): n is a, c, g, or t
  modified_base (237)..(237): a, c, t, g, unknown or other
  misc_feature (237)..(237): n is a, c, g, or t
tcagcgtctagtaccacgaccggtgctcgatttagtgtagtgtgaagggaaagggagggcagttggtagatgcccctctgggagagatcccaggggtgacagccatggaccctggaagggcctggctagggacagggaccagagccagtccagggagaggacagagccaatggactggggtntactgtaacagccctgctggcgaggacggtaccagggcaccgtcctcgagggacncccaagtcgctagccaaaggtccgggaccaaggacggtccgcccctagaaccgtggaacgaccaagtacggaacgacccgaaaggaccgtacgggaacctaagggtagggttacggtacggaaccggaaccccgttaggaacggaccggtacggttccggggccccgttacgggtaccccgaacgggaccgtacgggcccggtaccggttccgggacccccggtcggtccgtcggcccggttggtccgggttcgggttaccgtccgggtccgttacgggtcgggtcccgtcccggtacggtccgggcccgtttcggcggtttacccgaccgggtaccccgtagggtttccggtacggtacccgaaaccgggacggtaaaccgggcccgggtaaccccgtacgggacccgttacgggacccggtccgtacggtacgggttaacgaccgggtacaccggggtaccgttacctaccggacgtccggtaccggaccgggcgttacccggcgggtacgggtcggtaaccggccgaccggacccgacggaccccgtaccgaccgtcgtaccgtaccgtaccggttcccg

SEQ ID NO: 18645 - DNA, 595 bp, Homo sapiens
  misc_feature: GYAE6OF02F5G6D.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgcccatgctgcaagtcggccagaggtgcccctgaacctgaaggccaatgagacccaagacaggccaagtggttgtgagacccctgaggagctgggccctggtcccaggcagcgctggcccctgctgctgctgggtctggccagtggtccgcccagtcggcctgctcgccgtcccgaagttcggttcgcgtacccggacgaaacggccggggacccacggacccgtagggacgccgtacgaggttacggaacgcgacgccgacgttccgacgcccgtggcggacgccgtggtcggggcgtaggtccgaccggtcccgaacggcccaacccgaccgtcgtcctacgtccgttaccccgg

SEQ ID NO: 18646 - DNA, 585 bp, Homo sapiens
  misc_feature: GYAE6OF02FNY2K.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggggcccatgctgcaagtcgggccagaggtcgcccctgaacctgaaggccaatgagacccaagacaggccaagtggttgtgagaccccgtgaggagctgggccctggtcccaggcagcgctggccctgctgctgctgggtctggccagtcggtcgcccagtcggcctgcctgcgccaatggttgcaccgcgaaacgcggggacccaggaccctggacgcctcgaggttcggaagcgacgccgatcccgagccgtgaccggacgcccgtggtcggggcgtacgggtccacggccccgaaacgggcccgaaacccccgacgttaccgtaccaccgttccctcgttacccccccg

SEQ ID NO: 18647 - DNA, 615 bp, Homo sapiens
  misc_feature: GYAE6OF02HGUIU.14.70.G04.1.454.CMB.1.raw
  modified_base (186)..(186): a, c, t, g, unknown or other
  misc_feature (186)..(186): n is a, c, g, or t
  modified_base (238)..(238): a, c, t, g, unknown or other
  misc_feature (238)..(238): n is a, c, g, or t
  modified_base (398)..(398): a, c, t, g, unknown or other
  misc_feature (398)..(398): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtntactgtaacagccctgctggcgagagggaccagggcaccgtctccagggacnccatgctgcaagtcgggcaggaggtcgccctgaacctgaaggccaaatgacgacccaaagacaggaccaaagtgggttagtgacgaccccgtgaacggagctcgggaccctcggtcccacggcacgcgtcgtcggcccctgcgtcgctcgcgtcgggtcncggccagtcggaccgcccgagtcggtcctcgctcgccgacctaagtggtcgccgaccggacgaaacggccgggacccgtagaaccgnggtacnccgtcgagttcgaagtcagcccgataccgacgtcctggaccggacgtccgtgggtacgggcgttacggccgacgaccccgaaggaccccaacccgcgtacggtactacccgtacgttaccccgg

SEQ ID NO: 18648 - DNA, 800 bp, Homo sapiens
  misc_feature: GYAE6OF02HF46K.14.70.G04.1.454.CMB.1.raw
  modified_base (186)..(186): a, c, t, g, unknown or other
  misc_feature (186)..(186): n is a, c, g, or t
tcagcgtctagtaccacgaccggtgctcgatttagtgtagtgtgaagggaaaggggagggcagttggtagatgcccctctgggagagatccccaggggtgacagccatggacccctggaagggcctgggctagggacagggaccagagccagtccagggagaggacagagccaatggactggggtntactggtaacagccctgctggcgagagggaccagggcaccgtcctccgagggacgccctatgctgcaaggtcgggccagaggtcgccccgtagaaccgtacgaacggaccaaagtacggaacgaaccccaaacggaacgaacgggacccgaaagggttcggggtttaggtacggaacggacccccggttaggacggggagtccggtcgggccccgtcgggtccccgaaggccgacggccgcgtccggcccgtcggccgtcgtccgtcgtcggtcgggtcgtcggtaccgtcgttcggtccggccccgtacggtccggaccgtcggtcctcggcccgtaccccgtaacggttcgggttacgaccggaacccggaccggaaacggggcccgggaaaccccgacccgggaaccccgtcgggaccgacccgtacggtaacggttaccgggaacggccgtacgggacccgtaccgttacccggccgtaccggtcggacgggtaccgtccgggtacgggttcgggccggtacggtaccgaacccggaccccgtaaccgggacccccctaaaccccggaccgttacccggtacccggtacccttcccgtttaaccccccgg

SEQ ID NO: 18649 - DNA, 697 bp, Homo sapiens
  misc_feature: GYAE6OF02FMX5T.14.70.G04.1.454.CMB.1.raw
  modified_base (236)..(236): a, c, t, g, unknown or other
  misc_feature (236)..(236): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggncccatcgctgcaagtcgggccaggacggtgcccctgaacctggaacggccaatgagacccaagacaggccaagtggtgtgagacccctggaggagcgtgggcctggtcccaggcaggcgctcggccctgctcgctgctgggtctacggccagtcggtcgcccgagtcggccgtcggcctcggccggtccccgaagtccgggtttcggaccctaaccggaccggaaaacggcccgggggtaaccccacggaacccgtcgggaccgtcccgtcggtaacggttacgggaacgtcgaacggcccggtaactacccgacgtcccggtcggaccggtacggtcccgttcggggtacgggggccgtaaccggggttccgaacccgggccccggtaaaacccgggtcccccgaaaacccccggttaccgttaccggtaccccgtaccgttcccgtttaaccccccggg

SEQ ID NO: 18650 - DNA, 610 bp, Homo sapiens
  misc_feature: GYAE6OF02HH1IZ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaagccaatgagaccaagacaggccaagtggttgtgacgacccctggaggagcgtcgggtccctcgggtccccaggcgacgcgcgtcggcccctgcctgcctgccgtgggtctcggtccgtagtcggtccgccgacgtcggcctcgctcgccgtccgtaagtcggttcgcgaccgcgaacggcggggacccacggacccgtcggacgtcctacgacggtacgaacgcgacgccgactccgacgccctggccgacggtcgtcggtccggggacgcgggtcgaccgtacccggaaccggacccgaacccgcttaccgtcctaccgtcccttacccgg

SEQ ID NO: 18651 - DNA, 709 bp, Homo sapiens
  misc_feature: GYAE6OF02F43Q7.14.70.G04.1.454.CMB.1.raw
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcggccagacggtcgcccctagaaccctgaacggccaatgagacccaagacaggccaaagtgggttgtgagacccctgacggagcgtcgggccctggtcccaggcagcgctcggcccctgcgtgctgcgtgggtctggccagtcggtccgcccgtagtcgggcccgttagccgtcggtaccggccccgtaagttcgggttacgccgaacccggtaccgaaacggcccgggggaacccaacggaccccggtagggaccgtacccgtccggtaacggttacgggaaacggtcgaaccggaccggtaaccttaccgaaccggtcccggttaccgggccgggtaaccgtcccggtcgggtaccgggggacgtaacgggttacccggaccggaccccggaaaccgggccccaaaccccggtaccgttacccggtacccgtacccgttcccgttacccccgg

SEQ ID NO: 18652 - DNA, 627 bp, Homo sapiens
  misc_feature: GYAE6OF02IZYI1.14.70.G04.1.454.CMB.1.raw
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggtgtactgtaacagccctgctggcgagagggaccagggcaccgtcctccagggagcccatgctgcaagtcgggccagaggtgcccctgaacctgaagccaatgacgacccaagacaggccaagtgggtgtgagacccctgaggagctgggccctggtccaggcagcgctggcccngcngctggctgggtctggcctagtcggtcgcccgagtcggcctcggctcgcgcccgtaagtcggtcgcacgacgaacggccgggaccacggacccgnggacgccgtaccgaggttacggaagaccgacgtacccgacgttcccgacgcccgtcggaccggtaccggtccggtcgggtcggggacccggtaggtccgaaccgggaccccgaaaccgggaccccctaacccccggtaccgttacggtaccccgtaccgttcccgttaccccgg

SEQ ID NO: 18653 - DNA, 618 bp, Homo sapiens
  misc_feature: GYAE6OF02F49HA.14.70.G04.1.454.CMB.1.raw
  modified_base (431)..(431): a, c, t, g, unknown or other
  misc_feature (431)..(431): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggaggtcgcccctgaaccctgaacggcaatgaagacccaagacaggaccaagtgggttgtgagaccctgaggagctcgggccctcggtcccgaggccgacggcgtacgtcggcccctggcctgctcgcttcgggtctcggcctagtcggtccgcccgagttcggcctgcncggccgcccgtaagtcggttcgcaccggacgaacggccgggaaccacggacccgcggactccgtcgaggttacgacgcgacgccgacgccgacgccgaggcgacgcgtacggtgggaccgtcggtaccgaccggtaccgaccggaacccacccgaaccgttccgtacctccgttaccttacccccgg

SEQ ID NO: 18654 - DNA, 630 bp, Homo sapiens
  misc_feature: GYAE6OF02GK56M.14.70.G04.1.454.CMB.1.raw
  modified_base (540)..(540): a, c, t, g, unknown or other
  misc_feature (540)..(540): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcgggccagaggtcgcccctgaacctgaacggccaatgaacgaccaagacaggaccaaggtgggttgtggacgacccccgtggaggcggcgtcgggccctcgggtcccgaggcgacgccgctcggcccctgccgtgctggcgtgggtctcggctagtcggtccgccgacgtcggcctcggcgtcgccgtcccgtattcgggtcgccgaccgaccgaaaccgggccgggaacccgaccggacccgtagggcctaccgtaccgaggttacggaagtccgacgccgtacnccgagcccgtaggcggcgtccgtggcgggtcgacggtcgacgacccgaacggaccccaacccggtacgcgtcctacgtccgttaccccgg

SEQ ID NO: 18655 - DNA, 624 bp, Homo sapiens
  misc_feature: GYAE6OF02IURD0.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagaacccaagacaggaccaagtgggttgtgagacccctgaggagcgtgggccctgggtcccaggcaggcgctcggcccctgctcgctggctgggtctggccatcggtcgcccgagtcggcctgcctgccgccaagtcggtcgcaccgtcgaaacgccgggacccagaccccgtggaccgcctcgacgttcggaacgcgacgccgactcccgaagcccgtacggccggacgtcccgttagggtcgggggtccgtaacgggttccgaaccggtaccccgaaaccgggtaccccgaaccccgtaccgtaccggtaaccctccgttacccgtttcccccgg

SEQ ID NO: 18656 - DNA, 724 bp, Homo sapiens
  misc_feature: GYAE6OF02HZMP7.14.70.G04.1.454.CMB.1.raw
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
tcagcgtctagtaccacgaccggtgctcgatttagtgtagtgtgaagggaaaggggagggcagttggtagatgccctctgggagagatcccagggtgacagccatggaccctggaagggcctgggctagggacagggaccagagccagtccagggagaggacagagccaaatggactggggtgtactgtaacagccctgctggcgagaggaccagggcacgtcctcaggganccatgctgcgaagcgggcagagtcgccctgacctgaggccaatganaccaagacaggcaagtggtgtgagacccctgagagcgtggccgtacggtccaaggcagccggctcggcccctggcctcggctggcgtgggtactcggcctagtcggaccggtccccagtccggtccgtcggtcgtcggaccggtacccgtaaacggtcggttttacggaccgttaacccgggaccgaaaacggggtacccgggggaaccccgtaaccgggtaaccccggttacgggaaccggtccggttaccggaacgggttttaaccggggtaaaccgggaccgtaacgggacccgtaacggttcccaaccgggtaccacgggtaccggacggtacccggtgggttccgggggacggtaacgggtcccgaacgggtaccccgaaacccgggacccggtaaaccccgaaccgttacggtacccgtaccgttaccgtttaaccccgg

SEQ ID NO: 18657 - DNA, 527 bp, Homo sapiens
  misc_feature: GYAE6OF02HPQB0.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctggtctggccatcggtcgcccatcggcctgctgcgccaatggtgcacgcgaaagcgggacccagaccctggacgcctcgagttggaagcgagccgatccgagcctgcgagccgtggcgggcaggtcagcccgaaggcccaacccgactcgtcactctccg

SEQ ID NO: 18658 - DNA, 651 bp, Homo sapiens
  misc_feature: GYAE6OF02HR53L.14.70.G04.1.454.CMB.1.raw
  modified_base (378)..(378): a, c, t, g, unknown or other
  misc_feature (378)..(378): n is a, c, g, or t
tcagcgtctagtaccacgaccggtgctcgatttagtgtagtgtgaagggaaaggggagggcagttggtagatgcccctctgggagagatccccgaggggtgacagccatggaccctggaagggcctgggctagggacagggaccagagccagtccagggagaggacagagccaatggacgtggggtgtactgtaacagccctgctggcgagagggaccagggcaccggtcctccgagggacgcccatcgctgacaaggtcgggccaggaggtcgcccctgaacctgaacggccaatgagaccaagacagccaagtggtgtgagaccccgtgaggagcgtcggcctaggtcccaggcacggcgcgtcggccctgctgcngcgtgggtctcggcagtggtccgcccgtagtcggcctgcttacggccgtccaacgttgggttcgccgtaccggacgaaacggccggggaacccgaacggtaccccgtcggacgtcccgtagtacggttgggaacgtccgaacgcccgaagtcccgaccggacgttcggaccggtacgcccgtcggggttcggggccgtacgggtccgaacgggaccccgaaccggccccgaaaccccgtacgtacccgtacctaccgttcccgttacccccgg

SEQ ID NO: 18659 - DNA, 587 bp, Homo sapiens
  misc_feature: GYAE6OF02I1XGZ.14.70.G04.1.454.CMB.1.raw
  modified_base (266)..(266): a, c, t, g, unknown or other
  misc_feature (266)..(266): n is a, c, g, or t
  modified_base (386)..(386): a, c, t, g, unknown or other
  misc_feature (386)..(386): n is a, c, g, or t
  modified_base (469)..(469): a, c, t, g, unknown or other
  misc_feature (469)..(469): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccaggggcaccgtcctcgagggagcccatgctgcaagtcgggccagaggtncccctgaacctgaaggccaatgagaccaagacaggaccaaggtgggttgtggagaccccgtggacggagcgtagggccctgggtcccaggcagcgctcggccctgctgctgcgtgggtcncggcctagtcggtccgcccgagtcgcctgcctgccgccgaagttcggttcgcgaccgacgaaacggccgggaccacggaccgnggacgcctcgagttggaacgcgagccgatccgagccagacggagccgtagggtcgggtcgacggtacgacggacccgaacggcccaacccgtacgtcggtacctaccgtcttaccccg

SEQ ID NO: 18660 - DNA, 602 bp, Homo sapiens
  misc_feature: GYAE6OF02F5IYO.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgaggagggaccagggcaccgtcctccgagggacncccatgctgcaagtcgggccagaggtcgcccctgaacctgaacggccaatcgaagacccaagacaggaccaaggtgggttgtcgaggacccctggaggagcgtgggcctggtcccgaggcagcgctcggccctgctcgctgcgtggtctggcagtcggtcgccgatcggctcgctcgcgccgtaagtggttcgacacggacgaaacggccgggaaccacggacccgtgcgtaccgtacgtacggttaggaacgccgacgccgtacgtccgacgccgtggccggtacggcgtacgggcgggtcgacggtaccgaccggtaccgaacggacccaacccgcttacggcctaccgtcctaccccgg

SEQ ID NO: 18661 - DNA, 746 bp, Homo sapiens
  misc_feature: GYAE6OF02JIBSZ.14.70.G04.1.454.CMB.1.raw
  modified_base (181)..(181): a, c, t, g, unknown or other
  misc_feature (181)..(181): n is a, c, g, or t
tcagcgtctagtaccacgaccggtgctcgatttagtgtagtgtgaagggaaagggagggcagttggtagatgcccctcgtgggagagatccccgagggtgacagccatggaccctggaaggcctggctaggacagggaccagagccagtccagggagaggacagagccaatggactgggtntactgtaacagccctgctaggcgagaggaccagggccaccgtcctccgagggacgcccatggcctgcgaagtccgggccagaggtcgcccctagaaccgtgaacggccaatcgacgaccaagacaacggccaagtcgggttgacgacgaccccgtaggacggacgtccgtacgggccctcgggtaccccaggcgacgccgccgttcggcccctgaccgtgcgtcggccgtttcgggtaaccgtcgggacccgtaagttccggtaccgtccccgtagtttccggacccgtttcgacccgtttccggacccgtaccccgtaacgtttcgggttaaccgccgtaacccggtaacggaaaaccggtcccggggaaacccctacgggtaaccccgttcgggaaccgtacccggtaccgtacggttaacgggaaccgcgtaacggacccgtacttacccgaacggtcccgtacggaccggacgtccgtacggtacgggccgtaaggtcccgaacggacccgaacgaccccgtaacccgaccgtacggtaccctaccgttacccgttcccgg

SEQ ID NO: 18662 - DNA, 703 bp, Homo sapiens
  misc_feature: GYAE6OF02JN02V.14.70.G04.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaaatggactggggtgtactgtaacagccctgctggcgagaggaccagggcaccggtcctccgagggacncccatgctgcaagtcggccagaggtcnccctgaacctgaacgccaatgacgaccaagacagaccaagtggtgtgacgaccctgacgagcgtcgggcctcggtccgaggcacggccgcgtcggccctgctcgcgtcgcgtggtcgcggtcacgtcggtccgcccgtacgtcggccgtcgccgttcgccgtccgtaacgttcggttacgccggaaaccgtaccggaaacgggacccggggaacccaacgggtaccccgtacgggtaccgtccgtaccggtaacgggttcgaacggccgtaaacggacccggactacccggtaccggaccggtacgggtccggaacgggtccggtcgggttacggggacccggttaacggggtaccgtaaccggacccgtaaccggtacccccgtaaccccggtaacgttacccggaccgttaacccgttcccgtttaacccccggg

SEQ ID NO: 18663 - DNA, 709 bp, Homo sapiens
  misc_feature: GYAE6OF02JOAT0.14.70.G04.1.454.CMB.1.raw
  modified_base (333)..(333): a, c, t, g, unknown or other
  misc_feature (333)..(333): n is a, c, g, or t
  modified_base (588)..(588): a, c, t, g, unknown or other
  misc_feature (588)..(588): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgcgtggcgagagggaccaggggcacccgtcctccgagggacgcccattcgcttggccaaggtccggggaccaggaggtcgccccgtgaacctgaaggccaagtcgacgaccaagacaggccaaggtgggttgngacgaccccgtggaggacgcgtgggacccctggtcccgaaggtccgaggtcggccgtcgggcccctggactcggcctgcgttgggtcgtcggtccgtagttccgggccgtacccgcgtcggtcccgtggacccgttcggacccgtacccgtaacggttcggggttacgcccgtaacccggaccggaaaaccgggccggggtaaccccaacgggaccccgtagggaccgtcccgtaccggacggtacggtaaaccnccggtaacgacccggtacgtccgacgtccgtaacgccggacgtcgtacggcgggtacgacggtcgacgtacccgaagggaccccaacccgtaacctccggtaccgtacctccgttacccgg

SEQ ID NO: 18664 - DNA, 573 bp, Homo sapiens
  misc_feature: GYAE6OF02GMG4Y.14.70.G04.1.454.CMB.1.raw
  modified_base (238)..(238): a, c, t, g, unknown or other
  misc_feature (238)..(238): n is a, c, g, or t
  modified_base (450)..(450): a, c, t, g, unknown or other
  misc_feature (450)..(450): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggggtgtactgtaacagccctgctggcgagagggaccagggcaccgtcctccagggancccatgctgcaagtcggccagaggtgcccctgaacctgaagccaatgagacccaagacagccaagtgggtgtgagaccctgaggagctgggccctggtcccaggcagcgctcggcccgtgctgctgctggtctggcagtggcgcccacgtcggctcgctcgccgcccgaagtggttcgctaccgactaaacggccgggacccgacgacccgngacgcctcaggttcggaacgcgacgccgatccgacgccgtgccggtacgccgtggtcgggcgtaggtccgacggtcccgaacggacccaaccccgactaccggtacctaccgtccgtacccgg

SEQ ID NO: 18665 - DNA, 667 bp, Homo sapiens
  misc_feature: GYAE6OF02GCR22.14.70.G04.1.454.CMB.1.raw
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
tcagcgtctagtaccacgaccggtgctcgatttagtgtagtgtgaagggaaagggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacgcccatgctgcaaggtcggccagnggtgcccctagaacctgaacggccaatgacgaccaagacaggaccaagtggttgngacgaccctggaggagcgtgggccctcggccaggccagcgcgtcggccctcgctcgctggtcgtacggtcgcggcctagtcggtaccgccgagtcggccgtcgcgtacgcccgtaccgtaacggttcggtaccgaccgaaccgacggtaaaccgggcccgggaacccgtacggaccgtacggaccgtaccgtcgtacggttacggacgtaccgacggtacccgacgccgtacggccgtaccgggtacgcggtcccgttggggtaccggggtaccgtacgggccgtaaccggacccgaaccggacccccaacccggtaccgtacccgaccgtaccgttccggttccccccgg

SEQ ID NO: 18666 - DNA, 594 bp, Homo sapiens
  misc_feature: GYAE6OF02F9C3S.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtgcccctgaacctgaaggccaaatgaagaccaagaccaggccaaggtggtgtgacgacccctggaggagcgtgggccctggtcccaggcagcgctcggccctgctgctgctggtctggcagtcggtcgcccgagtcggcctgctcgcgcccaagtcgttcgcaccgacgaaacggccgggaacccacgacccgtcggacgtccgtcgtacggttggaacgcgtacgccgacgttccgaagcccgtggaccgacgtccgtggacgggctacgggtccaggtaccccgaacggccccaacccggtcctcgtacccgtaccgttccgttccccgg

SEQ ID NO: 18667 - DNA, 738 bp, Homo sapiens
  misc_feature: GYAE6OF02JMJZL.14.70.G04.1.454.CMB.1.raw
  modified_base (190)..(190): a, c, t, g, unknown or other
  misc_feature (190)..(190): n is a, c, g, or t
  modified_base (633)..(633): a, c, t, g, unknown or other
  misc_feature (633)..(633): n is a, c, g, or t
  modified_base (725)..(725): a, c, t, g, unknown or other
  misc_feature (725)..(725): n is a, c, g, or t
tcagcgtctagtaccacgaccggtgctcgatttagtgtagtgtgaaggaaagggagggcgagttggtagatgccctctggagagatcccagggtgacgagccatggaccctggaagggcctggctagggcagggaccagagccagtccagggagaggacagagccaagtggactggggtgtactgtaacngccctgcctggcgaggaggaccgtagggcaaccgtcctccgagggagtccccagtgctggacaagtcgggccaggtaggtcgcccctagaacccgtgaacgccgaagtagacgaacccaagaccacggtaccaaggtggttcgtacggagaccccttggaacggacggaccgtcggggacccctgggtccccgacggtaccgacggcggaccgtcggccccgtggccgcggtccgttcgcgtcgggtaccgttggacctaggtcggtccgcccggtgtaccgggtcctcggtccgtacggtcccggacccgtaacgttcgggttaacgcccgacgggtccgaaacccgggtcgggacccccgtaaggccccgttagggccgtccgtacgaacggttcggaacgtaccgacgggaccctaggttacccgaaccggtccggtacncccggggtaaccgtcccgttaagggtcggggtaccccggagggttccccaacggcccgaaacccgggcccaaccccgtacgccgtacgaccncccgtttacccgg

SEQ ID NO: 18668 - DNA, 676 bp, Homo sapiens
  misc_feature: GYAE6OF02H4BDD.14.70.G04.1.454.CMB.1.raw
  modified_base (238)..(238): a, c, t, g, unknown or other
  misc_feature (238)..(238): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccagaggtcgcccctgaacctggaaggccaatgacgacccaagacaggccaaggtgggttgtgacgaccccgtggaggagcgtcgggccctcggtcccaggcgagcgcgtcggccctgcctgctgcgtggtctcggctagtcggccgccagtcggcctgctcgccgacccgtagtcggtcgcgaccgacggaacgggcccggtaacccgacggacccgtagggaccgtcccgtacgtaggttacggacgtaccgacgtaccgactacccggacgtcccgtacggccgggtacgtcccggttacggggtccggggtacgtaaccgggtccggtaacccgggaccccggtaaacccgggaccccctaaacccccggtacctacccggttaacccgttaccccgttcccggttacccccccgg

SEQ ID NO: 18669 - DNA, 593 bp, Homo sapiens
  misc_feature: GYAE6OF02IW01E.14.70.G04.1.454.CMB.1.raw
  modified_base (386)..(386): a, c, t, g, unknown or other
  misc_feature (386)..(386): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagaccaagacaggaccaagtgggttgtgagacccctgaggagcgtgggccctggtcccaggcagcgctcgccctgctgctgctggtctggcagtcggtcncccgagtcggccttgctcgccgacccgtaagtcggtcgacaccggacgaaacggccggggaacccaggacccgtggaccgcctacgacggttcggaacgcgtacgccgactccgagccgtgcggacgccgtgggtcgggcacgggtccaacggacccgaacggaccccaaccccgacgttaccgtacctaccgttccgttaccccgg

SEQ ID NO: 18670 - DNA, 596 bp, Homo sapiens
  misc_feature: GYAE6OF02G4EV7.14.70.G04.1.454.CMB.1.raw
  modified_base (479)..(479): a, c, t, g, unknown or other
  misc_feature (479)..(479): n is a, c, g, or t
  modified_base (524)..(524): a, c, t, g, unknown or other
  misc_feature (524)..(524): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtccggccaggaggtcgcccctagaaccctgaaggccaatgagacccaagacaggccaaggtcggttgtgacgacccctgaggacgcgtgggccctggtcccagggcagcgctcggcccctgctgctgcgtgggtctgggcctagtcggtccgcccgtgtcggcctgccgtgccgtacccgagttcggttcgccgacccggacgaacggccgggaccacggacccgnggacgtccgtcgagttacggaacgcgacgccgactccgagtccgngcgacgtccgtggtcgggcgacggtccgacgacccgaacggacccacccgctccgtacctactccgtcccgg

SEQ ID NO: 18671 - DNA, 707 bp, Homo sapiens
  misc_feature: GYAE6OF02JKA3Q.14.70.G04.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (278)..(278): a, c, t, g, unknown or other
  misc_feature (278)..(278): n is a, c, g, or t
tcagcgtctagtaccacgaccggtgctcgatttagtgtagtgtgaagggaaaggggagggcgagttggtagatgcccctctgggagagatccccaggggtgacagccatggaccctggaagggcctgggctagggacagggaccagagccagtccagggagaggacagagccaatggactggggtntactgtaacagccctgctggcgagngggaccagggcaccgtcctccgagggacgcccagtgcctggacaacggtccgggccaggtaggtccnccccgtagaacctggaacgccaagtcgaacgaacccgaagacgacggaccaaggtggttagtacggacgaccccgtaggacggcggacgtacggggtccctacgggtcccgaggccgacgcgcgtcggccctgcgtcgctcgacgtgggtctcggacctagtcgggtccgaccacgtcggtcgtcgcgtcgccgtaccgacgtggttacgcctaccgggtacgaaacggtcccgggaaccgtaccggtacccgtacggaccgtacccgttcggaacggttacgggaacgtaccggaacgtacccggacgtaccgtacggtacccgtacgggacgtaccgtccgttagggccgggtacgtacgggtcctaaccggacccggtaccgaacccggtcccgaacgttccgtaccgaccggttccttaccccgg

SEQ ID NO: 18672 - DNA, 761 bp, Homo sapiens
  misc_feature: GYAE6OF02GYE5M.14.70.G04.1.454.CMB.1.raw
  modified_base (237)..(237): a, c, t, g, unknown or other
  misc_feature (237)..(237): n is a, c, g, or t
  modified_base (436)..(436): a, c, t, g, unknown or other
  misc_feature (436)..(436): n is a, c, g, or t
tcagcgtctagtaccacgaccggtgctcgatttagtgtagtgtgaagggaaaggggagggcagttggtagatgcccctctgggagagactccccgaggggtgacagccatggaccctggaagggcctgggctagggacagggaccagagccagtccagggagaggacagagccaatggactggggtgtactgtaacagccctgctggcgagaggaccagggcaccgtctcgaggacncccatgctgacaaggtccggccaggacggtcgcccctagaacctggaacggccaaatggacgaacccaagaccgaggaccaaggttgggttagtacggacgtaccccgtaggacgggacggccgtcggggtccccttagggtacccgagggacacggccgtaccgtcggccccctgccgtcgcgtcggcgttcgggtcncgggtcctacgtcgggtaccgtccccgtagtccgggtccgtcgtcccgtcgggaccgtccccgtaaaggttcgggttaccgacccgtaaccggaccgggaaaaccgggacccgggggtaaacccctaaccgggtaccccgtacggggaccgtacccgtacggtaacgttacgggaacgccgtaccggaccgtacgtccgtaccggtacccggtcgaccgggtacgtccgggtcgggtcggggaccggtacggttaccgaaccggtacccgaaaccggtacccgaacccgtacctacggtacccttacccgttaccgttacccccg

SEQ ID NO: 18673 - DNA, 649 bp, Homo sapiens
  misc_feature: GYAE6OF02F532Y.14.70.G04.1.454.CMB.1.raw
  modified_base (186)..(186): a, c, t, g, unknown or other
  misc_feature (186)..(186): n is a, c, g, or t
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
tcagcgtctagtaccacgaccggtgctcgatttagtgtagtgtgaagggaaaggggagggcaggttggtagatgcccctctgggagagatcccaggggtgacagccatggaccctggaagggcctgggctaggggacagggaccagagccagtccagggagaggacagagccaatggactggggtntactgtaacagccctgctggcgagagggaccagggcaccgtcctccagggacncccatgctgcaaggtcggccagaggtnaccctgaacctgaacggccaatgaanaccaagaccaggccaaggtggtgtgacgaccctggacggagcgtcgggcctgggtcccaggtcagcgcgtcggccctgctgcgtagcgttgggtctggccagtcgtccgcctagtcggccttgacgtcgcgtaccgtaagtggtacgacaaccggacgtaaacgggcggggtaaccctacgggaccctagggacgacccgtagacggttacggaacgcgtacgaccgacgttccgaacgtcccgtaggccggtagtccggtacggcgggggtaaccaccggggttacaccggtaccggtaaccggccccgtaaaccccggtaccgttaccggtaccgtacccgttccgttaccccgg

SEQ ID NO: 18674 - DNA, 632 bp, Homo sapiens
  misc_feature: GYAE6OF02I34IF.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtgcccctgaacctgaaggccaatgagaccaagacaggccaagtgggttgtggagacccctggaggagctgggccctggtccaggcagccgctcggccctgcctgctgctgggtctggcctagtcggtccgcctagtcgggcctgccgtcgccgacccgtaagtcgggttcgcgaccgtacggaacgggaccgggggaccccacgacccgtgggacgccctcggaacggttcgggaagcaacggccgtactccgacggtccctgggaccggacgtccgtagggcggggtcccgtcgggtaccgaccggtacccgaacgggtacccccctaaccccgtaccgtcgtacccgtaccgttcccgttacccccg

SEQ ID NO: 18675 - DNA, 737 bp, Homo sapiens
  misc_feature: GYAE6OF02IAI1M.14.70.G04.1.454.CMB.1.raw
  modified_base (241)..(241): a, c, t, g, unknown or other
  misc_feature (241)..(241): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaaccagggcaccgactccgtcgagggacncccagtcgcgtcgacgaacgggtccggaccgaggacggtccgaccccgtacggtaaccgtaggaaacggacctaagtacgaaccgaaccgaagacgtacggacgtaacgggtttggtacgtagacccgacccgtaggacggacgtccggtaccgggccccgttcgggacccgaggaccgtacggccggtcgtcccggtaccctggtcctcggtccgtcggtcgggtttcggcggtcggacctaggttccggtcccgaccgtacggtccggtccgtacgtccgtccggacccgtaccgtaagggtttccgtaccgacccggtaccgaaacgggtaacccggggacccggtaacccgtaacggaccggtacgggactcccgtagttacggtacggacgtaccgtacggccctagacccacggcgtcgaccggcgcggtggccggtacgcgccctaacggcccgacggaccccaaccgtcgtacgccttaccgtcccgg

SEQ ID NO: 18676 - DNA, 712 bp, Homo sapiens
  misc_feature: GYAE6OF02IKZC9.14.70.G04.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggccaccgtcctccgagggacncccatgctgacaagtcggcagaggtcncccctagacctgaagccaagtcgacgaccaagacaggaccaaggtggttgtgacgacccgtggaggagcgtcggcctggtcccaggccagccgcgtcggccctgcctgcgtcgcgtcggtctcggctagtcggtccgccgtagtcggccttcgtacgtcgcccgtaccgtaacggttcgggttaccgaccgtacccggaaccggaaaccgggtacccggggaaccctaaccgggaacccggttcggacccggtaccgtaccggtacgggttaaccggaaacgccggtaaccgaccggaacgttccccgaagggtcccgtacggacccgggtaccggtccggtcgggtccggggtccggaacgggtccaaccgggaaccccgtaaccgggaccctaaaccccggtcccgttaccgggtaccccttccggtacccgtttacccccg

SEQ ID NO: 18677 - DNA, 589 bp, Homo sapiens
  misc_feature: GYAE6OF02G1623.14.70.G04.1.454.CMB.1.raw
  modified_base (185)..(185): a, c, t, g, unknown or other
  misc_feature (185)..(185): n is a, c, g, or t
  modified_base (329)..(329): a, c, t, g, unknown or other
  misc_feature (329)..(329): n is a, c, g, or t
  modified_base (390)..(390): a, c, t, g, unknown or other
  misc_feature (390)..(390): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggagcccatgctgcaagtcgggccagaggtcgcccctgaacctgaacggccaaatgagacccaagacaggccaagtgggttgcgagaccctgaggngcgtgggccctggtcccaggcagcgcgtcggccctgctgctgctgggtctggcagtcggcncccgatcggcctgctcgcgccctaagtcggtcgcgaccgacgaaacggccgggaaccacggacccgtggacgccgtacgtaggtacggaacgcgacgccgactccgacgccgagccggtagccgtgggtcgggacgtacggtccgacgacccgaacggaccccaacccgtaccgtcggtaccctacgttccgtaccccg

SEQ ID NO: 18678 - DNA, 628 bp, Homo sapiens
  misc_feature: GYAE6OF02FOB8V.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaacggccaatgagaccaagacaggccaagtgggtgtgacgaccccgtgacggagcgtcgggcctcggtcccaggccagcgcgtcggccctgcctgctcgcgtgggtcgtggctagtcgtcgcctacgtcggtccgtgtcgtcgaccgtcccgtaagtcgggttcgaccgtaaccgacgaaaccgggacccgggaacccgacggtacccgtcgggacgtccgtcgtacggtagacgcgacgaccgctaccgcgaccgtcggcgacggtacgtcgggacgggcgtaccggtccgaacggacccgaaccggcccgaacccgtacgtccgtaccgtaccgttccgttaccccgg

SEQ ID NO: 18679 - DNA, 639 bp, Homo sapiens
  misc_feature: GYAE6OF02HXDJL.14.70.G04.1.454.CMB.1.raw
tcagcgtctagtaccacgaccggtgctcgattttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaggtgggttgtgagaccccgtggagggagcgtgggccctgggtcccaggcaggccgcgtcggcccctgcctgctggcgtgggtctgggcctagtcggtccgcccgagtcgggcctgccgtcgccgaccctaagtggttcgccgaaccgacgaaacggccggggaacccacggaacccgtcgggacgtccgtacgtaggttacggaagtccgacgccgacgtccaacggtcctacggccgtacgccgttagggtcggggctacgggtccaaccggacccgaaccgggtccctaaaccccgtaccgttacggtacccttaccgttccgttaccccgg

SEQ ID NO: 18680 - DNA, 756 bp, Homo sapiens
  misc_feature: GYAE6OF02FX4MY.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggcagaggtgcccctgaacctgaagccaatgagacccaagacaggccaagtggttgtgagacccctgaggagcgtgggccctggtcccaggcagcgctggccctgctgctggctgggtctggccgtagtcggtcgcccgagtcggcctcgctcggccgccctaaagttcgggtttacggcccgaaccggaccgaaaacgggcccgggggtaaaccccacgggtaaccccgtacgggaccgtacccgttaccggtaacgggtttacgggaaacggtcccgtaaacgggtaccccgtaacgttcccgaaacggtccccggttacggacccgggggttaaccggtaccccgggttacgggggttaccggggggaacccggttaaaccgggggttacccgaaccgggggtaaccccccggaaaaccggggtccccccgtaaaccccccggttaacccgtaacccgggtttaccccgttaacccgtttccccggtttaacccccggg

SEQ ID NO: 18681 - DNA, 625 bp, Homo sapiens
  misc_feature: GYAE6OF02H5DIH.14.70.G04.1.454.CMB.1.raw
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcggcaggagtcgccctgactgaaggccaangacgaccaagcaggccaagtggtngagccctagngagcgnggccctggtcccaggcagccgcgtcggccctgccgtgctcggcgtcgggtcctaggccagtcggtcgcccgtagtcggccgtgccgtgccgccctagtcggttcgccacgcgtaaacggccgggtacccacggtacccgtagggccgtaccgccgtacggtacggtaacgaccgacgtacccggacgttacccgacggtacccgtacgccggtacgcccgttcgggtacgggacgtacgggtccgaacggtacccgaacggtacccaccccgtaccgtccggtacctacccgtgttaccccg

SEQ ID NO: 18682 - DNA, 697 bp, Homo sapiens
  misc_feature: GYAE6OF02JIAWH.14.70.G04.1.454.CMB.1.raw
  modified_base (239)..(239): a, c, t, g, unknown or other
  misc_feature (239)..(239): n is a, c, g, or t
  modified_base (550)..(550): a, c, t, g, unknown or other
  misc_feature (550)..(550): n is a, c, g, or t
tcagcgtctagtaccacgaccggtgctcgatttagtgtagtgtgaaggaaagggagggcgagttggtagatgccctctgggagagatcccagggtgacagccatggaccctggaacgggcctgggctagggacagggaccagagccagtccagggacgaggacaggagccaatggacgtggggtgtactgtaacagccctgctggcgagagggaccagggcaccgtcctccgagggacncccatcggcctgaccgaaagtccgggccaaggtacggtcgccccgtgaacctgaacggaccaagtgacgacccaagacaggccaagtcggttagtcgagaccccgtgacgacggctcgggaccttcggaccgacggcacggcgccgtggcccctgccgtcgcgtgacgttggcgtcggccagtcggtacgccgtacgtcggcctacgtctgccgcctaaggtcgttacgaccgacggaccaaacgggcccgggaacccgacggtaacccctacgggtaccgtacccgtacgttaacgggttacgggaaccnccggaaccgggtacccgtaacgttcccgaacggtcccgtcggaccgggaacgggtccctagggttccgggccgtacggttacccggacggacccgaaccggtaccccgaacccgttacgtaccggtccgtaaccttcccggtacccg

SEQ ID NO: 18683 - DNA, 684 bp, Homo sapiens
  misc_feature: GYAE6OF02HAZKE.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggagcccatcgctgcaaggtccgggccagacggtcgcccctgaacctgaacggccaaatgacgaacccaagacgacggaccaaggtgggttgtgacgaccccgtggacggagcgtcgggccctcggtcccgaggcgacgcgcgtcggccctgctgcgtgcgtggtcgtggccgagtcggtccgcccgacgtcggtcctcgcgtcggccgcccgtaaggtcggttcgacgaccgacgaaaccgggaccgggtaacccaccggacccgtcggaccgtaccgtacgtacggttacggaacgtcgaacgtccgacgtccgtaaccggccgtacgggaccggtccggtaccggtacgggtcggggaccggtacggtccggaaccggtaccccggaaccggtaccccgtaaacccggtaccgttaccggtaccctaccgttcccgttaacccccgg

SEQ ID NO: 18684 - DNA, 634 bp, Homo sapiens
  misc_feature: GYAE6OF02HXUDQ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggcaggaggtcgcccctgaacctgaaggccaatgagacccaagacaggccaagtcgggttgtgagacccctggaggagctgggccctggtcccaggcagcgctggccctgctgctgctgggtctggccagtcggtcgcccgtatcggcctgctcgccgcccaagtcggttcgcgaccgcgaaacggccggggaacccacggaccctggacgcccgtacgagttacggaacgcgacgccgactcccgaacgtcccgtacggaccggacggtacccgttgggtacgggggcccgtagggtcccgaaccgggtaccccgaaaccgggtcccccgaaaccccgtccgttaaccggtaccctacccgtacccgtttacccccggg

SEQ ID NO: 18685 - DNA, 687 bp, Homo sapiens
  misc_feature: GYAE6OF02H2I8F.14.70.G04.1.454.CMB.1.raw
  modified_base (187)..(187): a, c, t, g, unknown or other
  misc_feature (187)..(187): n is a, c, g, or t
  modified_base (238)..(238): a, c, t, g, unknown or other
  misc_feature (238)..(238): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
tcagcgtctagtaccacgaccggtgctcgatttagtgtagtgtgaagggaaaggggagggcagttggtagatgcccctctgggagagatccccagggggtgacagccatggaccctgggaagggcctgggctagggacagggaccagagccagtccagggagaggacagagccaatggactggggtntactgtaacagccctgctggcgagaggaccagggcaccgtctccgagggcnccatgctgacgaagtcgggcaggaggtcaccctagacctgaaggccaatgagacccaagacaggccaagtggttgtcgacgacccctgaggngcgtgggccctggtcccagggcacgcgctcggcccngcgttgccgtgaccttgggtctaggcctacgttcggacccgtcctacggtcggtccgtggccgtcggtaccgtaccccgtaaagttccgggttccgtacggtaccccggaacggaaaccggaccgggggtaccccaaccgggtacccggtaccggaccgtaccgtaccgtacgggttaacgggaaccgccgtaccggtacccgacgttccgacggacctcggacgggccgtaccggtccgggtcggggctacgggttacgacggtaccccgaacggtaccccgaaccccggaccttacggtacctaccgtcgttaccccgg

SEQ ID NO: 18686 - DNA, 539 bp, Homo sapiens
  misc_feature: GYAE6OF02FHK6F.14.70.G04.1.454.CMB.1.raw
  modified_base (240)..(240): a, c, t, g, unknown or other
  misc_feature (240)..(240): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (517)..(517): a, c, t, g, unknown or other
  misc_feature (517)..(517): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccggtcctccagggacncccatcgctgcaagtcgggccaggaggtgcccctgaacctgaacggccaatgagacccaagacaggccaagtggttgtgagaccctgaggagctagggcctggtcccaggcagcgctcggcccngctgctgctggtctggcagtcggtcncccgatcggcctgcngcgccaagtcggtncgaccgcgaaacggcgggaccagccnggacgcctagagttgagcgagccganccgagcgtgcgagcgtgtcggcgaggcacgccgaacgccgaacccncgtccgtctacgtcgttacccg

SEQ ID NO: 18687 - DNA, 683 bp, Homo sapiens
  misc_feature: GYAE6OF02FWC1A.14.70.G04.1.454.CMB.1.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagactccccgaggggtgacagccatggaccctggaagggcctgggctagggacagggaccagagccagtccagggagaggacagagccaatggactggggtntactgtaacagccctgctggcgagaggaccagggcaccgtcctccgagggacncccatgctgacgaagtcgggaccaggacggtcgccccgtagaacctgaacggccaatgacgaccaagacgacggccaaggtcgggttgtggacgaccccgtggacggagcgtcgggtcccgtggtcccaggcgacgcgctcggcccctggcctggcctggtccgtgggtcgtcgggcctacgtcgggtccgcccgtacgtcggccttacgccgtcgccgcccgtaagttcggttaccgaccgaccgacgtaaaccggccgggaacccgaccggaccggtacggacgtcccgtcgtaacggttacgggaacgccgacggacccgacgttaccgacggccgtacggccggacgtccggtgggtcggggacgtacggtccggaccgtacccggaaccgaccccgtaaccccgtcgtaccggtacctacccgttccgttacccccgg

SEQ ID NO: 18688 - DNA, 589 bp, Homo sapiens
  misc_feature: GYAE6OF02F9SWY.14.70.G04.1.454.CMB.1.raw
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtcgcccctgaacctgaaggccaaatgagacccaagacaggaccaagtgggtgtgagacccctgaggagctgggcctggtccaggcagcgctcggccctgctgctgctgggtcnggccatcggtcncccgagtcggcctgtcncgccgcccaagttcgggttcaccgtaccggacgaaacggccggggaacccacggacccgtcggacgcctcgagttcggaagccgacgaccgactccgacgccgtgaccggtagccgtggcgggccgaggtccgaacggacccaacgggacccaaccccgcgtaccgtcacccttccgttacccgg

SEQ ID NO: 18689 - DNA, 580 bp, Homo sapiens
  misc_feature: GYAE6OF02H0P92.14.70.G04.1.454.CMB.1.raw
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (503)..(503): a, c, t, g, unknown or other
  misc_feature (503)..(503): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagaccaagacaggccaagtgggtntgacgacccctggaggagctgggcccctggtcccaggcagcgcgnggccctgcctgctggctgggtctggccagtcggtccgccgactcggcctggcctcgccgcccgtaagtggtacgtcgaccgacgaaacggcgggacccgacgacccgtggacgctcgaggtcgaagcgtacgccgtacacgcgccgngcgacgccgtaggcggggctacggtcgaccgaacccgaacgcccgtaacccgaccgtacgtcctaccgtcctacccg

SEQ ID NO: 18690 - DNA, 636 bp, Homo sapiens
  misc_feature: GYAE6OF02HQNU4.14.70.G04.1.454.CMB.1.raw
  modified_base (261)..(261): a, c, t, g, unknown or other
  misc_feature (261)..(261): n is a, c, g, or t
  modified_base (391)..(391): a, c, t, g, unknown or other
  misc_feature (391)..(391): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagnggtcgcccctgaacctgaaggccaaatgagacccaagacacggccaaggtgggttgtgacgacccctggaggagcgtcgggccctcggtcccaggcacggcgcctcggcccctgctgctcgcgtgggtcnggcctagtcggtccgccctagtcggccgtcggccgtcggcccgtccgtaaggttccggttaggcccgaaccggacggtaaaccgggaccggggaccccgaacggacccggtcggacgtccgtacggtacggttacggaacgtccgacggaccgacgtaccgagtcccgcgtcggacgcgtcgggacgggcgacggtcgaccgcccgaacggaccccaaccggactccggtaccacgtcctcccgg

SEQ ID NO: 18691 - DNA, 635 bp, Homo sapiens
  misc_feature: GYAE6OF02H1XJR.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagactccccaggggtgacagccatggaccctggaagggcctgggctagggacagggaccagagccagtccagggagaggacagagccaatggactgggtgtactgtaacagccctgctggcgagagggaccagggcaccggtcctccgagggacncccatgctgcgaagtcggcagaggtcgccctgaacctgaaggccaagtgacgacccaagacgacggccaagtgggttgtgacgaccccgtgaggacgcgtcggcctaggtcccaggcagcgcgtcgccctgctgctgcgtggtcggccagtcggtaccgccgtagtccgcgttcgcgtcgaaccgtcccgtaagtcggttcgacgtacccggacgtaacgggaccgggtacccacggtacccgttgggaaccgtcctcgtacggtacggaacgtccgacgtacccacgtccgcgaccgtgggtccgaggtcccgtacggtcgggaacgtcggtccaaccggacccgtaacggtaccccgaacccgtaacgttccgaacctccgtccttcccccgg

SEQ ID NO: 18692 - DNA, 739 bp, Homo sapiens
  misc_feature: GYAE6OF02HYPRT.14.70.G04.1.454.CMB.1.raw
  modified_base (265)..(265): a, c, t, g, unknown or other
  misc_feature (265)..(265): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggagcccatgctgcaaggtccgggccaggnggtcgcccccgtagaaccgttggaacggaccaagttcggaacgaaccccaaagaaccgaggtacccgaaaggttcgggttagtgaacggaacccccgttggaggaacggcgtcgggccccgtaggtccccgaggccgacggccgccgtcggcccctgccgtcgctgcgtcgggtcgtcgggcctacgttcggtcccgccgtacgtcggcctcggccttcggcccggtacccctaaggttgggttacgcccgtaaccggaccgaaaaccgggtacccgggaaccccgaccggaccccgttcgggaacccgtccgtaacggtacggttacggaacgaccgaacgccgtaacgtccgaacggtcccgtcgggacggacgtaccgtgggtacgggcgtaccgggtccgaaccggtaccccgaaaccggaccccgtaacccgtacccgttccgtacccgtacccgttccttacccccgg

SEQ ID NO: 18693 - DNA, 606 bp, Homo sapiens
  misc_feature: GYAE6OF02GZPTW.14.70.G04.1.454.CMB.1.raw
  modified_base (185)..(185): a, c, t, g, unknown or other
  misc_feature (185)..(185): n is a, c, g, or t
  modified_base (382)..(382): a, c, t, g, unknown or other
  misc_feature (382)..(382): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagaggaccagggcaccgtcctccgagggagcccatgctgacaaggtcggccaggaggtcgccccttgaacctgaacggccaagtgacgacccaagacacggaccaagtggttgtgacgaccccgtggaacggacgtccgtcgggcccgtggtcccaggtcagccgcgtcggcccngctcgctgcgtggtctgccgagtcggcgccgtagtcggcctcgctcggccgcccgtagtcggttcgacgaccgacgaacggccggtaccacgaccgtgacgtctcgacgtaggacgacgacgaccgacgtacgaaccgcgtacggacgtacggcgtcggtcgggccgagtccgacggacccgaacgggtcccaaccgccgttacgtaccgtacttccgtacccg

SEQ ID NO: 18694 - DNA, 730 bp, Homo sapiens
  misc_feature: GYAE6OF02H45OU.14.70.G04.1.454.CMB.1.raw
tcagcgtctagtaccacgaccggtgctcgatttagtgtagtgtgaagggaaaggggagggcgagttggtagatgccctctgggagagatcccaggggtgacagccatggaccctggaagggcctgggctagggacagggccagagcagtccagggagaggacagagccaagtggacgtggggtgtactggtaacagccctgctggcgagagggaccagggcaccgtcctcgaggggactcccagtcgctgactaaggtccgggcaggaggtcgccctagacgtgaaggccaatgacgaccaagactacggccgtaaggtgggtgtcgtaacgaccccgtggaacggagcgtacggtcccgtcggtcccgaaggcgacggtcgcgttccggcccgtacggcttacggctcggtacgtcgggtacgtcgggtcccgtagtccgggtaccgcccgtagtcgggtcccgtcggtccgtacggcccgtaacccgtaacggttcgggttaccggccggtacccgtaccggtaaacgggaccggggaaccccgtaccggtaaccgacgggtaccggtaccgtacgtacggttacgggaacgtccgtaacggtcccgaattacccggacgtccggtacggacggtaccgccggttaggtccggggacgtaccggttaccggccggtaaccgaccggtacccgaacccgtacgtaccgtacgtaccgtcgttaccccgg

SEQ ID NO: 18695 - DNA, 643 bp, Homo sapiens
  misc_feature: GYAE6OF02H2XH7.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacatccctgctggcgagagggaccagggcaccgtcctccagggagcccatgctgcaagtcgggccagaggtcgcccctgaacctgaaggccaatgagacccaagacaggccaaggtggttgtgagacccctggaggagcgtcggcccgtggtccccgaggcacgcgccgtcggcccctgcgtcgctggctgggtcgtacggccagtcggtccgcccgagtcggccgtcgccgtcgccgccctaagtcggttcgccgaccgaccgaaacggccgggaacccgagacccgtggacgcctcgaggttacggaacgcgacgcccgaatcccgaacgcccgtcggaccggtacggccgttgggtacggggccgtacgggtacccgaacggtacccccgaaccgggaccccaacccccgtacgttacccgtaccgtacccgttccgttaacccccgg

SEQ ID NO: 18696 - DNA, 595 bp, Homo sapiens
  misc_feature: GYAE6OF02GNWOZ.14.70.G04.1.454.CMB.1.raw
  modified_base (328)..(328): a, c, t, g, unknown or other
  misc_feature (328)..(328): n is a, c, g, or t
  modified_base (459)..(459): a, c, t, g, unknown or other
  misc_feature (459)..(459): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaaggtcgggccaggaggtcgcccctgaacctgaacggccaatgagacccaagacaggcaagtggttgtgagaccctgaggngctgggcctggtcccaggcagcgctcgccctgctgctgctggtctggccagtcggtccgcccgtagtcggcctgtcctcgccgccctaagtcggtcgaccgaccgacgaacggccgggacccacgacccgnggacgcctcgagttacggacgcgacgcgactaccgagcctggaccggacgtcgtcgggtcggggcgtacggtccgaccggtacccgaacggacccaaccccggtacgtaccgtacctaccgttcccgttaccccgg

SEQ ID NO: 18697 - DNA, 803 bp, Homo sapiens
  misc_feature: GYAE6OF02IZXI9.14.70.G04.1.454.CMB.1.raw
  modified_base (242)..(242): a, c, t, g, unknown or other
  misc_feature (242)..(242): n is a, c, g, or t
tcagcgtctagtaccacgaccggtgctcgatttagtgtagtgtgaagggaaaggggtagggcagttggtagatgcccctctgggagagatccccaggggtgacagccatggaccctggaagggcctgggctagggacagggaccagagccagtccgagggagagggacaggagccaatggactggggtgtactgtaacagccctgctggcgagaggaccagggcaccgtcctccgagggacnccatgcctgcgaaggtcgggccagacggtcgcccctgaacctggaacggccaaatgacgaaccaagaccgaggacccaaggtgggttgtcgacggaccccttggaacggacggacgtcggggacccgttgggtaccccgaggccgaggccggtccgtccggcccctcggtctacggtcctcggcgtacggggtcgtcggtccgtaagtcgggttccgcccgtacgtccggtccgttaccgtccgttacgggtaccgtaccccgtttaacggtacgggtttccggaccgaaccggtaaccgggaaaccggggcccggggaaacccggacccggaacccgggttaccggtaccggtccccgtacgggtaaccgggtttacggaacgggttaccggaacccgggaacccggtaacgtccccgggtaacggtaccgggttaccggtaccgggtaccgtccgggtacccgggtcgggggtaacccgtacgggtaacccgtacgggaccccgtaacccggaaccccgtaccccgtagtcccgttacctaccgtacccgtttccccgg

SEQ ID NO: 18698 - DNA, 621 bp, Homo sapiens
  misc_feature: GYAE6OF02GCZ5C.14.70.G04.1.454.CMB.1.raw
  modified_base (416)..(416): a, c, t, g, unknown or other
  misc_feature (416)..(416): n is a, c, g, or t
  modified_base (471)..(471): a, c, t, g, unknown or other
  misc_feature (471)..(471): n is a, c, g, or t
tcagcgtctagtaccacgaccggtgctcgatttagtgtagtgtgaagggaaagggagggcagttggtagatgcccctctgggagagactccccgaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgacaaggtcgggccaggaggtcgcccctgaacctgaacggcaatgacacccgaagacaggaccaaggtgggtgtggacgaccccgtggaggagtcgtcgggccctggtcccgaggccgagccgcgtcggccccgtgcctcgctgcgtgggtctcggccagtcggtccnccgactcggcctgcgtccgcgacctagtcgtcgcaccgacgtaacgccgggaccncgcccgtgcgcctagacgtacgagcgaccgacgcgtaccgagtccgcggtccgacggtccgtcgggcgggtcgtacgggtacctaccggacccgtaacccgggaccctaaccccggtaccgttacggtccctacccgtcccttaccccgg

SEQ ID NO: 18699 - DNA, 582 bp, Homo sapiens
  misc_feature: GYAE6OF02F4FV1.14.70.G04.1.454.CMB.1.raw
  modified_base (455)..(455): a, c, t, g, unknown or other
  misc_feature (455)..(455): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggtgtactgtaacagccctgctggcgagagggaccagggcaccgtcctccagggagcccatgctgcaagtcgggccagaggtgcccctgaacctgaaggccaatgacgacccaaagacaggccaaaggtggttgtgagacccctggaggagtctgggccctggcccaggcagcgctggccctgctgctgctggtctggccagtcggtcgaccctagtcgcctagcgtgcgacccgagtggtcgcctacgacgaacggccgggacccacgaacccnggacgccgtactaggttacggaagccgtacgaccgacgtccacgtcctggaccggtagccgttaggtccggggcaaggtccgacgtacccgacggacccaacccgactcggtacaccgttctacccg

SEQ ID NO: 18700 - DNA, 690 bp, Homo sapiens
  misc_feature: GYAE6OF02J3BYN.14.70.G04.1.454.CMB.1.raw
  modified_base (239)..(239): a, c, t, g, unknown or other
  misc_feature (239)..(239): n is a, c, g, or t
  modified_base (274)..(274): a, c, t, g, unknown or other
  misc_feature (274)..(274): n is a, c, g, or t
  modified_base (364)..(364): a, c, t, g, unknown or other
  misc_feature (364)..(364): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctaggggacagggaccagagccagtccagggagaggacagagccaatggactggggtgtactgtaacagccctgctggcgagacggaccagggcaccgtcctcgagggacnccacgctgcaacggtcggaccagacggtcgccccngaaccgtgaacgccaatgacgtacccaaagcgacggccaaggtgggttctcggacgcccgtggacggagcgtcgggcccttcggtacccnggccaggcccgcgtccggcccctgccgtctcggtcgacgtcgggtactccgcgacgtcggtccgtacccgaggtccgggtcctcgactccggacccgtccgtaacggtcggtcgccgaccgaacgtaccgggaccgggaccctacggtacccgcggtaccgccgtagacgggttacgaacgccgacgaccgtcgacggtccgtcgtacgggccgtacggtccggacgtacggggaccgtcgggtacccaaccggggaccccttaacgggaccccgtacccgtacgggtaccctccggtacccgttcccggttcccgtaccccccgg

SEQ ID NO: 18701 - DNA, 703 bp, Homo sapiens
  misc_feature: GYAE6OF02H972X.14.70.G04.1.454.CMB.1.raw
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (424)..(424): a, c, t, g, unknown or other
  misc_feature (424)..(424): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggcagaggtcgccctgacctgaacggccaagngacgacccaagacgaggactaaaaggtgggttgcggaacgtaccccgtaggaggacgccggtccgggccccgtcgggtaccccgaggccgacgtccggccgtccggcccctgtccgtgtcgtcggccgtttgggtccncggtaccgtacgtcgggtcccgcccgtagtccggtcctcggccgttccggaaccggtacccctaaggtttcgggtaaccgcccgaaacccggaccgggaaaacccgggcccggggaaacccgtaccggacccggtacggaccgtacccgtaggtacggtacgggaaccgccgacggaccacgtcccgacgccgtaggccgacgtcgttgggccggcgtaacggccgaacggacccgaaccgacccgaaacccgtcgtccgtcgtacctaccgttccccg

SEQ ID NO: 18702 - DNA, 689 bp, Homo sapiens
  misc_feature: GYAE6OF02HUSST.14.70.G04.1.454.CMB.1.raw
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
tcagcgtctagtaccacgaccggtgctcgatttagtgtagtgtgaagggaaagggagggcagttggtagatgcccctctgggagagatccccgagggtgacagccatggaccctggaagggcctgggctagggacagggaccagagcagtccagggagaggacagagccaatggactggggtgtactgtaacagccctgctggcgaggaggaccgagggcctaccgtcctccgagggacnccctatgctgacgaaggtccggaccaggtaggtccnccccgtagaccgtgaacggacctaatagaacgaacccgaaggaacgaacggtacccgaaagttcggggtttagacgaacggtacccctagggacggacgaccggtcggcccgttacgggtccccgacggcacggcgacgtccggcccgtcgcgtgctagctggctcgcgcgtagccggtcgaccgacgtccgcgtcgcgttaccggcccgtaccgtaggtcggtcgacccgaacggtaaccgaaccgggtacccgggaaccacccggtaacccgtacgacgtacccgttagtaacggttacgacgtacgacggccgttacgaccgacgccgtaggccggacggcgttacgggcggaccgcggtaccgacgacccgacccgaccgaccccgtacgtacctcctacgttacccgg

SEQ ID NO: 18703 - DNA, 675 bp, Homo sapiens
  misc_feature: GYAE6OF02HQYZS.14.70.G04.1.454.CMB.1.raw
  modified_base (579)..(579): a, c, t, g, unknown or other
  misc_feature (579)..(579): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcggccagaggtcgcccctgacctggaaggccaatgaagacccgaagacgacggaccgaaggtgggttgtagaacggaccccgtggaacggagccgtcgggccccgtgggtccccgaggcacggccgcgtcggccccgtcgcgtcgcgtcgcgtacgggtctcggcctagtcggtccgcccgagtcggaccgtgccgttcggcccgtacccgtaagttcggttcgaccgtaccggaaccgaaaccgggtccggggaacccgtacggacccgtacgggaccgtacccgtacgtacggttacggacgacgacgccgtactcccgacgaccncggccggacgccgttgggtcgggcgtcgggtaccgaccggacccgaaccggaccccgtaacccgtccgtaccgtacctaccgtcccgttaccccgg

SEQ ID NO: 18704 - DNA, 615 bp, Homo sapiens
  misc_feature: GYAE6OF02IUDJX.14.70.G04.1.454.CMB.1.raw
  modified_base (185)..(185): a, c, t, g, unknown or other
  misc_feature (185)..(185): n is a, c, g, or t
  modified_base (238)..(238): a, c, t, g, unknown or other
  misc_feature (238)..(238): n is a, c, g, or t
  modified_base (476)..(476): a, c, t, g, unknown or other
  misc_feature (476)..(476): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactgggtntactgtaacagccctgctggcgagaggaccagggcaccgtcctccgagggacncccatgctgcaagtcgggccaggaggtcgcccctagaacctgaaggccaagtgacgaccaagacaggaccaagtggttgtgagacccctgaggagctgggccctggtcccaggcaacgcgcgtcggccctgctcgcctcgctgggctggcagtcggtcgcccgagtcggctcgctacgccgtcccgaattcggtcgtcgaccgacgtaaacggccgggtacccacggacctgggaccnccgtacgaggttagaacggtcgacgaccgatcccacgccgtgccggacggcccgtgggtccgggacgccgggttacgaccgacccggtaaccggacccgaaccccgacgtacccggtaccacccgttcccgttaccccg

SEQ ID NO: 18705 - DNA, 635 bp, Homo sapiens
  misc_feature: GYAE6OF02GSUE2.14.70.G04.1.454.CMB.1.raw
  modified_base (236)..(236): a, c, t, g, unknown or other
  misc_feature (236)..(236): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggngcccatgctgcaagtcgggccagaggtcgcccctgaacctgaaggccaatgagaccaagacaggccaagtgggttgtggagacccctggaggagcgtcgggccctgggtcccgagggccaggccgctcgggcccctgcctgctgcgtggtcgtcggccagtcggtcgcccgagtcggcctggcctcgccgtcccgaagtcggttcgccacccggtacgaaacggccggggaacccacggacccgtcgggacgtccgtcgaggttcggaacgcgacgaccgacgtcccgacgtccgtacggccgtacggccgttcgggacggggtccgagggtccgaacggaccccggtaacggacccctaacccgtaccgtaccggtacctaccgttcgttaccccccg

SEQ ID NO: 18706 - DNA, 637 bp, Homo sapiens
  misc_feature: GYAE6OF02HB4BL.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtcgccccgtgaacctgaaggccaatgagacccaagacaggaccaagtgggttgtgacgacccctgaggagcgtgggccctcggtcccaggcaggcgcgtcggcccctgctgctgcgtcgggtctcggcctagtcggtccgcccgacgtcggcctgcctcggccgtacccgtagtcggtcgaccgtaccggacgaaaccggccggggaacccacgggacccgtagggaccgccgtacggacggttaggacgacgacgtccgactcccgagcccgtaggccggacgtcggtcgggtcgggcggtacggtaccgaccgtacccggaaccggtaccccaaccccggtacttaccggtacccgtaccttcccggtaccccg

SEQ ID NO: 18707 - DNA, 729 bp, Homo sapiens
  misc_feature: GYAE6OF02J2CTY.14.70.G04.1.454.CMB.1.raw
  modified_base (469)..(469): a, c, t, g, unknown or other
  misc_feature (469)..(469): n is a, c, g, or t
  modified_base (704)..(704): a, c, t, g, unknown or other
  misc_feature (704)..(704): n is a, c, g, or t
tcagcgtctagtaccacgaccggtgctcgatttagtgtagtgtgaagggaaaggggagggcagttggtagatgcccctctgggagagatccccagggggtcgacagaccagtgggacccctggaaggggcctgggctagggacagggaccagaagccagtccagggagaggacagagccaatggactggggtgtactgtaacagcctgctggcgagaggccagggcaccgtcctccgagggacgcccagtcgctggccaaggtccggggccaggacggtgccccctgaaccgtgaacggccaagtgacgaccaacgacgacggccaaggtgggttacgtggacgaaccccgtgacggacgcgtcgggcccgtacggtcccgagggccacggtccggcgttcgggcccccgtggcccgtcggtccgtcggtccggtaggggtccgtacggccgtacggtcggggtacccnccgtagtcgggtccgtcgccgtcggccgtcccgtacggttcggttcgccgtaaccgggccgaaacgggaccgggacccctacggacccgtacgggaccggtacggtaccgtagggttacggaacggtccgtaccgggccggtaactcccgtaacggcccgttcgggaccgtaccgggtccgtggggtccgggccggtacggtcggtacccgacccgaccggacccgaccccgtanccggttaccaccgttccgtacccgg

SEQ ID NO: 18708 - DNA, 592 bp, Homo sapiens
  misc_feature: GYAE6OF02G145O.14.70.G04.1.454.CMB.1.raw
  modified_base (186)..(186): a, c, t, g, unknown or other
  misc_feature (186)..(186): n is a, c, g, or t
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
tcagcgtctagtaccacgaccggtgctcgatttagtgtagtgtgaagggaaaggggagggcagttggtagatgcccctctgggagagactccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgcaagtcgggccaggacggtgcccctgaacctgaacggccaatgaagacccaagacaggccaaggtgggttgngacgacccctggacggagtcgtgggccctgggtcccaggcaggcgctcggccctgctgctgctggctggccagtcggtcnccctagtcggcctgctcgcgccgaagtcggtcgccaccgacgaaacggccgggaacccacggacccgtagggaccgtccgtacgtacgttacgggaacgtcgacgccgtactccgagccgtgccgagtccgtggtcgggcacggtcacgacccgaacggcccaacccgacgtcgtacctaccgtcgtacccg

SEQ ID NO: 18709 - DNA, 660 bp, Homo sapiens
  misc_feature: GYAE6OF02GG1G6.14.70.G04.1.454.CMB.1.raw
  modified_base (268)..(268): a, c, t, g, unknown or other
  misc_feature (268)..(268): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccaggaggtcncccctgaacctgaaggccaatgagaccaagacaggaccaagtgggttgtgagacccctgacggagcgtgggccctgggtcccaggccgagccgcgtcggcccctgcctgctgcgtgggtctggcctagtcggtccgccctagtcggccgtgcgtcgccgcccgtagtcggttcgccgaccggacgaaacgggccgggaacccgacggaccccgtaggaccgcctacggaggttacggaacgtcgaacggtcccgtacgtccgaaccgtcccgaggaccggacggtaccggttcgggccggggtccggaacgggtccgtaacccggaccccgaaaccgggtcccccaaaccccggtaccgttccggacccgttaacccgttccgttacccccg

SEQ ID NO: 18710 - DNA, 732 bp, Homo sapiens
  misc_feature: GYAE6OF02FUAJ9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggggtgtactgtaacagccctgctggcgagagggaccagggccaccgtcctccagggacgcccatgctgcaaggtcgggccagacggtcgcccccttgaaccctggaacggccaagtcgacgacccaagacacggccaaggtgggttgtagacgtaccccgtggaggagcgtcggggccctcgggtcccgaggcacggcgcgtcggcccctggctcgctcggaccgttggactcgtacggtcctacggttccgggtccgtaccccgtagttccgggcccgttaggcccgttccgacccggtcccttaaagggttccgggttacgacccgaaccggtccggaaaaccgggtcccggggaaccccgtaccgggaccccggttacgggaccgaccccgtttgacgggttaaccggaagcccgtaacggtccaacggtaccccgaggccgtacgggccgggtacgtccgtacggggtcgggtaccgccgggtaccggaccgaccccggaacggtaccccaaccccgttggtacccgttacccgaccgtttccccgg

SEQ ID NO: 18711 - DNA, 691 bp, Homo sapiens
  misc_feature: GYAE6OF02JF3R6.14.70.G04.1.454.CMB.1.raw
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagaggaccagggcaccgtcctccgagggacgcccatgctgacgagtccgggaccaggacggtcgcccctagaaccctggaacggacctaagtacgacgaacccaagaccgacgggacccaaggtcggttggtgaccgacccgtaggaggaggaccgtcggggaccctcggggtacccagggtccgacggcgcgttccgcccgtgcgtcgcgtcgcgtcggtcgtgggcctacgtcggccgacccggtacgtcggtacgtcgtccgcgccgacctaggttggtccgacgaaccgtcggaaaccggcccgggaaccgaccggtacccgtagggaccttccgacgtaaggttaacgggacgtaccgacggcgtaaccgacccgtcgcccggtacgaccgggtagtacccgtgggtacccgggcgaacggtaccgccggaacccgtaccgaccccgaacccgtnacccggtcnccgttaccgtccccgg

SEQ ID NO: 18712 - DNA, 729 bp, Homo sapiens
  misc_feature: GYAE6OF02FR1YT.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacagagccaatggactggggtgtactgtaacagccctgctggcgagagggaccagggccacccgtcctaccgagggacgccatgctgaccaaggtccggaccaggacggtcgaccccgtagaacccgtaggaacggccaagtacgaacgaaccgaaacgaccgaaggaccgtaaggtcggggttagtacggaccgtaccccgtagggaacggacggtccgtcggggtccccgtcgggtaccccgaacgggtcgacggccgtcgtccggtccccgtcgaccgtcgcctcggcggttcggtaccgtcggtaccgacggtccggtacccgtacccgtacggtaccggtcgtacggctccggaccgtacccgtaagttcgggttacgcccgtaacccggacgaaaccgggcccgggaacccgacgtacccggcgaacgtcctacggacgttaggaccgacgaccgacctacgtaccaccgtcgtcggcgacgccgtcgggcgggacgtacggccgaacggtacccgaccggacccacccgtacgtaccgtaccgtacctcctacccccg

SEQ ID NO: 18713 - DNA, 728 bp, Homo sapiens
  misc_feature: GYAE6OF02IEPE7.14.70.G04.1.454.CMB.1.raw
  modified_base (278)..(278): a, c, t, g, unknown or other
  misc_feature (278)..(278): n is a, c, g, or t
  modified_base (628)..(628): a, c, t, g, unknown or other
  misc_feature (628)..(628): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgaggagggaccacgggccaccgtccctccgagggacgccccatcgctgacaaggtcgggccaggacggtcnccccgtgaacctgaacggccaagtcgacgacccaagacgaggaccgaaggtggttgtggacgacccgtggaggacgcgtcggccgtcggtcccgaggcaggcgcgtcggccctgcgtgcctggcgttcggtcgcggtaccgtagttccggtcccgcccgtacgtcgggtccctcgtacccgcgtacccgaccccgtaaggttccgggtacggccctaaacccgggaccggaaacccggaccgggggaacccctaccgggaaccccggtgtaccggtacccgtcgaacggttacgggaacgaccgtaccggaccgaccctacgacgtcccggaggtcccgacggttcccgngggtccggggtacgtaaccgggtccgaaccggtaccccgtaaacccgggccccgtaaaccccgtaccgttcgtaaccccgttaccgtccgttacccccgg

SEQ ID NO: 18714 - DNA, 720 bp, Homo sapiens
  misc_feature: GYAE6OF02I7GWV.14.70.G04.1.454.CMB.1.raw
  modified_base (357)..(357): a, c, t, g, unknown or other
  misc_feature (357)..(357): n is a, c, g, or t
  modified_base (422)..(422): a, c, t, g, unknown or other
  misc_feature (422)..(422): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggagcccatgctgcaagtcgggccagacggtcgcccctgaacctgaacggccaatgacgaccaagacaggccaagtcgggttgtgacgacccctggaggacggcgtcgggcccgtcggtcccgngggccacggcgccgtcggcccctggccgtcgcgtcgcgtgggtctcggcctagtcggtccgccgngtcgcctgccgtcgccgcccgtagttcggttcgccgtaccgaccgaaacggccggggtaacccgacggtaccccgcgggtaccgtacccgtacgtacggttacggggaaacgtaccggaacgtacccggtacgtacccgtaaccggtcccggtcgggtacccgggtaccgtacccgggtcgggtaccgggggtccggaccgggttaccggaacccggttaaccccgaacccgggttaaccccgaacccccggtaccgttaccggtaccccgtaacccgttcccgttttaaccccccgg

SEQ ID NO: 18715 - DNA, 614 bp, Homo sapiens
  misc_feature: GYAE6OF02FE3LL.14.70.G04.1.454.CMB.1.raw
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggcaccgtcctccagggacgcccatgctgcaagtcgggccaggacggtgcccctgaaccctgaacggccaatgagacccaagacaggccaagtggtgtgagacccctgaggagcgngggcctcggtcccaggcagcgctcggccctgctgctgctggtctgcagtcggtccgcccgtatcggcctggctcgcgcccaagttggtcnccgtaccgacgaaacggtccggggacccacggacccgtgggacgccgtcgaggttcggaacgtcgacgccgactccgaacgtccgtggccgggacgtccgtagggtcggggacgacgggtccgaaccggtaccccgaaacgggacccccaacccgtaaccgtcgtaccgtaccgttcccgttaccccgg

SEQ ID NO: 18716 - DNA, 626 bp, Homo sapiens
  misc_feature: GYAE6OF02JFW39.14.70.G04.1.454.CMB.1.raw
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
  modified_base (570)..(570): a, c, t, g, unknown or other
  misc_feature (570)..(570): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatcgctgcaaggtcgggccaggaggtcgccccgtagaaccctgaacggccaagtgaacgaaccgaagacgacgggccaaggtgggttgtagacgacccctggaggcgcgtcgggcccgtggtcccgaggcncggcgcgtcggcccctgccngcgtcgccgtggtcgtcggcacgtcggccgccagtcggcctgcgcgccgaccgtacgtcgtcgacctaccgacggaaccggccgggacccgaccggaccgacggcgtccgtcgacgttggaacgcgacgaccgcgtaccgacgccgcggcgacgccgtgggaccggcgtacggtcnccgtacccggaaccgacccgaaccccgtcgtaccgacttaccgttccgtaaccccg

SEQ ID NO: 18717 - DNA, 843 bp, Homo sapiens
  misc_feature: GYAE6OF02JLKVU.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggccaccgtcctcgagggacgcccatcgctgacgaagtcgggccaggacggtcgcccctagaacccgtggaacggccaatcggaacgaacccaaaggaccgaacggaccgtaaggttcggggttacgtacggaaccggtaccccgtaggggaacggaacggtccggttaccgggggtacccctacgggtacccgtaacgggccgaacggtccggtaccgtcgggtcccccgtaggtccgttcggtaccgtcggtccggtttcgggtccgtaacggtaccgtaacggttccgggtacccggtaccgttcggtccgggtcccgtcggtaccggtcccggtaccgtaccccggtaacggtttcgggttaaccggtacccgtaacccggtaacgggtaaacccggggtcccggggtaaaccccgtaaccgggttacccgggttaccgggtaacccggtacccgttaccggtaacgggttaacggtaaccgtacccgggaccgtaccggtaccgtcccgtaaccggtccggtaccgggacgtaccggttcggcgggttacggggtccacgggtaccggacccgtaccggaccgtacccgaccgtaccgttacgccgtactcccgtacccgg

SEQ ID NO: 18718 - DNA, 658 bp, Homo sapiens
  misc_feature: GYAE6OF02GONL4.14.70.G04.1.454.CMB.1.raw
  modified_base (382)..(382): a, c, t, g, unknown or other
  misc_feature (382)..(382): n is a, c, g, or t
tcagcgtctagtaccacgaccggtgctcgatttagtgtagtgtgaagggaaaggggagggcagttggtagatgccctctgggagagatcccaggggtgacagccatggaccctggaagggcctgggctagggacagggaccagaggccagtccagggagaggacagagccaatggactggggtgtactgtaacagccctgctggcgagaggaccaggacaccgtctccagggacgcccatcgactgacaagtcgggccagaggtcgacccctgaacctgaacgcaatgacgaccaagacacggccaagtcgggtagtagacgtaccctggacggacgcgtcggacctggtcccaggcacgcgacgtcggccctagcctcgcncgtacgtcggtcgtggcctagtccggtccgcccgtagtcgggtcctcggtcgtcggacgcccgtagttacgggtcgcgtaaccgacgtaacggaccgggaccgtacggcccgtagacgtcctacgacggttacggaagtaccggacgaccgtacgaccgtaccgtacggccgtaccgggaccgtaccggtggttaccggggcggtaccgggtacgacccggtaccggaaaccggacccgaaccccgtacgtacgacccgtaccgtccgttaccccg

SEQ ID NO: 18719 - DNA, 639 bp, Homo sapiens
  misc_feature: GYAE6OF02JSH05.14.70.G04.1.454.CMB.1.raw
  modified_base (342)..(342): a, c, t, g, unknown or other
  misc_feature (342)..(342): n is a, c, g, or t
tcagcgtctagtaccacgaccggtgctcgatttagtgtagtgtgaagggaaagggggagagaggagcccagccctgggattttcaggtgttttcatttggtgatcaggactgaacagagagaactcaccatggagtttgggctgaactggcttcttcttgtggctattgtaaaaggtgtccagtgtgaggtgcaactgttggagtctgggggaggcttggtacagcctgggggtcccgtaaaactctcctgtgcaacgtctggattcagcttcagtagttatggtcatgcactgggtccgccgaaggctccaggcgaaggggctgggagtgggtgcagttgngtggtatggacgaagtaatagaaagtatgccgacgccgtagaacggccgattcacatctccagagacaattccaaacacatgtagtatactgcaaatcgaaatacgactacgaagaacggaccggtagggaaccaccggggtacttacggtacgttaactttaacgttcggttagttaccgaggttaaggtaacgggtggggtaaaggggggtttggggtacggtaaccgtttaccgtaaacgggggtttacttaagggtacgttttagggttaccggtttaacccgttaaacccgg

SEQ ID NO: 18720 - DNA, 674 bp, Homo sapiens
  misc_feature: GYAE6OF02J0LCS.14.70.G04.1.454.CMB.1.raw
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
  modified_base (520)..(520): a, c, t, g, unknown or other
  misc_feature (520)..(520): n is a, c, g, or t
tcagcgtctagtaccacgaccggtgctcgatttagtgtagtgtgaagggaaaggggagggcaggttggtagatgcccctctgggagagatccccaggggtgacagccatggaccctggaagggcctgggctagggacagggaccagagccagtccagggagaggacagagccaaatggactggggtgtactgtaacagccctgctggcgagagggaccaggggcaccgttcctccagggancccatgactgcaagtcgggccagnggtcgcccctgacctgaacggccaatgagaccaagacaggccaagtcgggtgtgagacccctggacggaagccgtgggccctggtcccgaggccagcgctggcccctgcctgctgcgtgggtctggtcccaagtcggttaccgcccgtagtcggtccctcgcgttcggaccgcccgtaagtcggtacgcgaaccgtcaaacgggccggggaacccacggacccgtacgggcacccgttcaggtttaccgggaacncggaaccggtcccggtaacgttaccccgaacgggtcctaccgggaccggaccgggtacttgggttaccggggcctaacggggtcctaaccggaccccgaaacgggcccccaaacccgtaaccgtcggttacccgtaaccgtcccgttaccccgg

SEQ ID NO: 18721 - DNA, 729 bp, Homo sapiens
  misc_feature: GYAE6OF02JA4UJ.14.70.G04.1.454.CMB.1.raw
  modified_base (341)..(341): a, c, t, g, unknown or other
  misc_feature (341)..(341): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccagtgcctgacaacgtcgggccagacggtcgcccctgaacctgaaggccaatcgagaccaagacacggccaaggtgggttgtgacggacccgtgacggngcgtcggccgtcggtccgacggcaggcgccgtcggccctggtcctgcctcggtcgtcgggtacgtcggaccgtagtccggtacccggcccgtacggttccggtccgtccgggtaccgtcggtacccgtccccgtaaggttccgggttcgccgtacccggacgaaaccggtccggggaaccctaccggtacccggtagggaccgtcccttaccgggtacggttacgggaaccgtaccggaccggtaaccgtaacgtccgacggtccgttaccggccgggtaccggtaccgtagggtaccggggtcaccggggttccgacccggtaacccggaaccggccccgtaaacccaccggttacccggtacgtacccgttcccgtttaccccggg

SEQ ID NO: 18722 - DNA, 730 bp, Homo sapiens
  misc_feature: GYAE6OF02H4EA1.14.70.G04.1.454.CMB.1.raw
  modified_base (240)..(240): a, c, t, g, unknown or other
  misc_feature (240)..(240): n is a, c, g, or t
  modified_base (637)..(637): a, c, t, g, unknown or other
  misc_feature (637)..(637): n is a, c, g, or t
  modified_base (668)..(668): a, c, t, g, unknown or other
  misc_feature (668)..(668): n is a, c, g, or t
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagaggacagagccaatggactggggtgtactgtaacagccctgctggcgagagggaccagggcaccgtcctccgagggacncccatgctgacaaggtccggccaggaggtcgcccctagaacctggaacggtccaaagtcggaacgaacccccgaaagacctaacggacctaaaggttggggttgtacgacggtaacccccgttaggaacggacgtccgtccgggcccgttccgggtccccgaagggccacggtcgaccggtccggtccctcggccttcggctgggtccgttacgggtcgtaccggtccgtaacggtcgggtaccgtacccgtacgttccggtccgtggtaccgtccggacccgtaccgtaaggttcggtacgaccgaaccggtaacggaacgggtaccgggacccaggtacccgagaccgtacgtacgaggtacgacgtacgacggaccgtacgaccgcgtaccggngaccggacgtcgtcggcgggacgaccggtanaacccggtaccgaccggtacccctaaccgtacgtccggtacctaccgttcccgttaccccgg

SEQ ID NO: 18723 - DNA, 690 bp, Homo sapiens
  misc_feature: GYAE6OF02GICA7.14.70.G04.1.454.CMB.1.raw
  modified_base (241)..(241): a, c, t, g, unknown or other
  misc_feature (241)..(241): n is a, c, g, or t
  modified_base (352)..(352): a, c, t, g, unknown or other
  misc_feature (352)..(352): n is a, c, g, or t
  modified_base (627)..(627): a, c, t, g, unknown or other
  misc_feature (627)..(627): n is a, c, g, or t
tcagcgtctagtaccacgaccggtgctcgattttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggcaccgtcctccgagggacncccatgctgcaaggtcgggccagaggtcgccccgtgaaccgtgaacgaccgaagtagaacgaaccaagacgacggaccgaaggtgggttagtaggacgacccgtggacggngcggtcggtcccgtcggtacccgaggaccgacggccgtacgtccgggcccctggccgtgtcgtggtccgtcgggtcgcggcctaggtccggtcccgaccgtacggtcgggtccgtacggccgtcggacccgtacccgtaagttcggttcgaccgtaccggaaccggaacgggtacccgggacccgaccggtaccgacggaccgtcccgtaggacgttacggaacgcgaaccgtcgaccgtccgacgaccgtcggacgtcgcgtgggacggtccgnggtaccgaccgtaccgaccgtaccccgaccgtaccgtacgtacccgtacgtcccttaccccgg

SEQ ID NO: 18724 - DNA, 655 bp, Homo sapiens
  misc_feature: GYAE6OF02I64AL.14.70.G04.1.454.CMB.1.raw
  modified_base (380)..(380): a, c, t, g, unknown or other
  misc_feature (380)..(380): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccagtgctgcaagtcgggccagaggtcgccctgaacctgaaggccaatgagaccaagacaggaccaagtgggttagtgacgacccctgaggagctgggcccgtggtcccaggcagcgctcggccctgctgctcgcgtggtcnggcagtcggtcgccgagtcggcgtgctcgccgaccagtggtacgctaccgaccgaaacggccggggaacccacggcccgacgggacgtcctaccgaggttacggaacgcgacgaccggtacgtacccgacggtcccgtggaccggtaccggccggttacggggacgggtaccggaaccgggttacccgaaccggtacccccgaaaacgggaccccccgtaaacccccgtacccggttaccggtaacccttaaccccgtcccgtttaaccccccgg

SEQ ID NO: 18725 - DNA, 750 bp, Homo sapiens
  misc_feature: GYAE6OF02I5EZD.14.70.G04.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (628)..(628): a, c, t, g, unknown or other
  misc_feature (628)..(628): n is a, c, g, or t
tcagcgtctagtaccacgaccggtgctcgatttagtgtagtgtgaagggaaaagggagggcagttggtagatgcccctctgggagagactccccaggggtgacagccatggaccctggaagggcctgggctagggacagggaccagagccaggtccagggacgaggacagagccaatggacgtgggtgtactgtaacngccctgctggcgagacgggaccagggcaccgtcctcgagggcncccatgctgcacggtcggccaggaggtcncccgtagaacctggaacgccaagtcgaacgaaccccgaagacgtacggaccgtagggttacgggttagtacggaaccggtaccccgttaggaacgggtacgtccggtcgggtccccgtcgggtaccccgaagggtccgaggtcccggaccgttcgggccccctggcgtcgtccgtcggtcgttgggtacgttccggctttaggccgggtaccctcccggtagtccggtccgtcggtactcgggaccgtaccgtagttcgggtcacggtaaccggacggaaaccggggcccggaaccgtcgggacccgtaggtaccgcctacggtaacgtgggaacctccggaagtccgaacgttaccnggtacccgtcgacgggtaccgtccggttaggccggggtactacgggacctaccgggacccccgtaaccggtcccgtaacccgtcgttacccgggtaaccctcccgtttacccggtacccccg

SEQ ID NO: 18726 - DNA, 750 bp, Homo sapiens
  misc_feature: GYAE6OF02J1UY9.14.70.G04.1.454.CMB.1.raw
  modified_base (190)..(190): a, c, t, g, unknown or other
  misc_feature (190)..(190): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagcgtctagtaccacgaccggtgctcgatttagtgtagtgtgaagggaaaggggagggcagttggtagatgcccctctgggagagatccccgagggtgacagccatggaccctggaagggcctgggctagggacagggaccagagccagtccagggacgaggacagagccaatggactgggtcgtacngtacacgcctgcgtgcgagacggacacggcaccgtcctcgacgganccctanggctagcaaggtccgggacaaggcgtcgccctagaacgtgaacggaccagtgaccgacctaaggacgaggaccgtaggttcggtagtacgacgtccgtagaacggaggcctgggaccgtggtccccgaaggtccgacggtcgacgcggtcccgtagccgttcgactcggcgttacgggttcgaggcctcggtccgtccgtccgtgttcccggtcgtcggtcccacggtaccgtacccgtaacggttcggtccgaccgaacgtaaccgaacggaccgggttaccgaaacggttcccggtaaccgtcgaccccggttaggtacgtaaccgggttacaccgggaaccttaccggacggtttaccgaccgttaaacccggcggtaaccggttaccggtcggtagggggtaccggtacggttaaaccgggtaccgaacccggtacccggtaaccggtaaccccccgtaaccggccgtttacggtacccggtacgtttccccggtttaaccccg

SEQ ID NO: 18727 - DNA, 727 bp, Homo sapiens
  misc_feature: GYAE6OF02HUEM8.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagacgggaccagggcaccgtcctccagggacgcccgatggctgcaaagtcgggccagaggtcgccccgtagacccttggaacggcctaaatcggaacgacccgaaagacgaacggaccaaacggttgggtacggttacgaacggtacccccttaggaacgggtaacgccggttacggggtcccccgttcgggtacccccgtaaggacgacggtcggtccgttacgggccccgttacggcgtacgctaggtccgtcgggtaccgtcggcccgtaaggtcggttaccggcccgtaacggtccgggtacccgtggtcccgttacggacccgttaccccgaacgtttcgggttacgaccgacccggtaacgaaaaccgggccggggaaccccgtacgaacccggttcggaaccgtccgtacgcgttaagggacgtacgacgccgaagcccgagccaggccgcgcgtcggcgggtcacggcgacgacccgacgcccgaaccgcttacgaccgtccgtcgtacccg

SEQ ID NO: 18728 - DNA, 638 bp, Homo sapiens
  misc_feature: GYAE6OF02HX89J.14.70.G04.1.454.CMB.1.raw
  modified_base (392)..(392): a, c, t, g, unknown or other
  misc_feature (392)..(392): n is a, c, g, or t
tcagcgtctagtaccacgaccggtgctcgattttagtgtagtgtgaagggaaaggggagggcagttggtagatgcccctctgggagagactccccagggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaaggtcgggccagaggtcgcccctgaaccctggaaggccaaatggacgacccaaagacacggccaaggtggggttgtggaagccccgtggaggaggctgggccctggtcccaggcagcgctggccctgctcgctgctggtcnggccagtgtcgcccagtcggcctgccgtcgccgccgaagttcggttcgccgacgtaccgaaacggcccggggacccgacggacccgtaggacgtcctacggacggttagaacggcgtaaccggaccggacgtcccgaaggcccgtcggaccggtaccgccggtcggtcggggcggtacggtcgtaaccggacccgaacgggaccccaaccccgtaacgtcccgtccgtacccgttcgttaccccgg

SEQ ID NO: 18729 - DNA, 1031 bp, Homo sapiens
  misc_feature: GYAE6OF02F2AA3.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccgagggagaggacaggagaccaagtggacgtggggtgtacgtagtaacacgccctgctgggcgaggacgggacgagggcctaccgtcctaccgagggacgcccagtcgctcgacgacggtccgggaccaggacggtccgaccccgtagaaccgtggaacggaccaagtacgaaccgaacccgaaagaccgacggtaccctaagggttggggttacgttacggaacccggtaccccgttaggggaacgggtaccggtaccgggtcccggggtccccggttaccgggttaccccggaagggaccgtaaccgggtccggtacccggttacccgggtcccccttcgggacccgttccgggtccgttcgggtccggttcggggttccggtaaccgggtccgtacggttacccggggtacccgtccggtaaccgttcggggtacccgttacggttccggtacccggacccggttaaccccgttaagggtttccgggttaaccgtaccccgggttaaccccggaaaccggggtaaaccccggggtaccccggggtaaaccccgttaaccccgggaacccggttaaccggggtaccccttcccgggttaacgggttaaaccggggttaccggggtaaaccggaccccggttaaccgggtcccggaaccgttaccccggtaaccgggtccccggtaaccgggtaccgggtaccccgggttacccgggttaccggggtacccggggttccgggaaaccggggttaccccggaaaccccgggaaccccggttaaaaccccggaccccccggtttaaacccccggtaaccggttaccccgggtttaaacccgttccccccggtttaaccggttttaccccccccccgggg

SEQ ID NO: 18730 - DNA, 799 bp, Homo sapiens
  misc_feature: GYAE6OF02GIK6R.14.70.G04.1.454.CMB.1.raw
  modified_base (240)..(240): a, c, t, g, unknown or other
  misc_feature (240)..(240): n is a, c, g, or t
  modified_base (372)..(372): a, c, t, g, unknown or other
  misc_feature (372)..(372): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagacgggacagggcaccgtcctccgaggggancccatgctgcaagtccgggccaggacggtcgcccccgtggaaacccttggaaaggtacccaaagtcgaacgaaccccaaaggacacggacccaaaggtggggttagtacggacggaaccccctggaacgggngaccgtcggggccccgtttcggggtacccctaacggggcgaacggccgtacgtcgggcccccctggcctggcctggcttcggggtctcgggtaccctggttaccgggttcccgcccgtaacgtcgggtcccgtacgggctcggtccggaccccgtaaaggttcggtacgggaccgtaacccgggaccggtaaaaccgggcccggggaaaccctaccgggaaccccgttacgggaacccggtcccgtacgggttaacggttacgggaaacggaccgacgggtaacccggtacgacccgtaacgtcccgtcggaccggaccggtcgttacggggccgggtccgggaccgggttacccggaacggacccccggtaaaggccccctaaaccccggaccgttaccggcccttaccggtcccgtttaccccgg

SEQ ID NO: 18731 - DNA, 641 bp, Homo sapiens
  misc_feature: GYAE6OF02JRRSS.14.70.G04.1.454.CMB.1.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (576)..(576): a, c, t, g, unknown or other
  misc_feature (576)..(576): n is a, c, g, or t
tcagcgtctagtaccacgaccggtgctcgatttagtgtagtgtgaagggaaaggggagggcagttggtagatgccctctgggagagatccccaggggtgacagccatggaccctggaagggcctgggctagggacagggaccagagccagtccagggagaggacagagccaatggactggggtgtactgtaacagccctgctggcgagacgggaccagggccaccgtccnccgagggcgtcccatgctgcagtcggcagngtcnccagacngagcaatganaccagcacgcaggtggttangacgccctgagagccgtacggccctggcccgagaccngccgtcgtcgggccctgccttgcgtcgcggttacggtcgtcggccgtaggtccggtccgacccgttaggccggtaccgtcgtcgccgaaccggaccgtacggttcggttaccgacgtaacccgggaaccgaccggggaccggggtaacccgtacccggtaccggtccgggaactcccgtacggttacggtcgggaacgaccggaacgtccgtaacgccgtacgccgtaagccggtacncggtcgacgacggcgtccgaacgaccgaaccgtccacccgtacgtccgcctacgtccgttacccg

SEQ ID NO: 18732 - DNA, 619 bp, Homo sapiens
  misc_feature: GYAE6OF02FSB46.14.70.G04.1.454.CMB.1.raw
  modified_base (237)..(237): a, c, t, g, unknown or other
  misc_feature (237)..(237): n is a, c, g, or t
  modified_base (417)..(417): a, c, t, g, unknown or other
  misc_feature (417)..(417): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccaggaggtcgcccctgaacctgaagccaatcgagacccaagacaggccaagtggtgtgagacccctgaggagctgggccctggtcccaggcaggcgctggtcccctgctcgcttgttcgggtctggccatggtcgccatggctgctgcgcccaagtggttncgaccgcgaaacgcggggaacccagacccgtggacgacctcgtaacggttaggaacggtcgaacggcccgagtaccccgaagccgtacgccgggagtcccgttagggtcgggacgggtacggtcggtaaccggaccccgaaacgggacccccgaaacccccgtacgttccgtaccgtacctacgttcccggttacccccccg

SEQ ID NO: 18733 - DNA, 769 bp, Homo sapiens
  misc_feature: GYAE6OF02IZS3D.14.70.G04.1.454.CMB.1.raw
  modified_base (246)..(246): a, c, t, g, unknown or other
  misc_feature (246)..(246): n is a, c, g, or t
  modified_base (677)..(677): a, c, t, g, unknown or other
  misc_feature (677)..(677): n is a, c, g, or t
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagagacagagccaatggactggggtgtactgtaacagccctgctggacgaggagggaccgagggccaccggtcctccgaaggggacnccagtgctgaccaaggtcgggaccaggtaggtcgccctagaacctaggaacggccaatcggaacgaacccgaaaggaccgaggtaccgaaagggttggggtttacggacggtaaccgacccgttggaacgggtacgtccggtcggggtccccgttacgggaccccgagggaccggacgtccgggtccgtccgggtaccccttggcccgtcggtaccgttcgggtccggttggggttaccgttacgggccgttacgtccggggtcccgtaccccgtaagggtttcccggggacccgtttcggaccgttccgggccgtaccgtaacggttccgggttcgacccgtaccggaaccggtaaaccgggaccggggaaccctaccgaccggtcggaacccgtcgtaaccggtgtaacggtaacgcgaagccgtaacnccgacgccggtagccggtcgtcgtacggtgggacgtcggtccgacgacccgtacggacccacccgtccggttactccgtctacccgtacccg

SEQ ID NO: 18734 - DNA, 681 bp, Homo sapiens
  misc_feature: GYAE6OF02IP0HN.14.70.G04.1.454.CMB.1.raw
  modified_base (414)..(414): a, c, t, g, unknown or other
  misc_feature (414)..(414): n is a, c, g, or t
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaacgtcgggccagaggtgccccgtgaaccgttgaaggcccaatcgacgaccaagacaggccaaggtgggttgtgagaccccgtggacggagctggggcccctgggtcccagggcaggccgcgtcggcccctgcctggctggacctgggtctcggctagtcggtaccncccgagtccggccgtggccctggccgcccgtaagtggttcaccgaaccgtcgaaacggtccggggaacccacgggtaccccgtggaaccgcccgtacgtacggttcgggaaacgtcgacggtccgaagtcccgtaaggccccttgggacccgggacggtcccgtcgggttacgggggcctaaccgggttcgaccggtaccccggtaaaccgggccccgtaaacccccgtcgttacccggtacccgtaccgttccccgttaccccggg

SEQ ID NO: 18735 - DNA, 678 bp, Homo sapiens
  misc_feature: GYAE6OF02IZLH3.14.70.G04.1.454.CMB.1.raw
  modified_base (184)..(184): a, c, t, g, unknown or other
  misc_feature (184)..(184): n is a, c, g, or t
  modified_base (404)..(404): a, c, t, g, unknown or other
  misc_feature (404)..(404): n is a, c, g, or t
tcagcgtctagtaccacgaccggtgctcgatttagtgtagtgtgaagggaaagggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgcccatcgctgcaagtcgggccaggaggtcgcccctgaaccgtgaacggccaatgacgaacccaagacaggccaaggtgggttgtgacgacccctggacggagcgtgggcccctggtcccaggcagcgcgtggccctgctgctgcgtgggtctcgaccagtcggtcnccgatcggcctgcgtcgccgccaagttcggtcgccgtaccgacgaaacggccgggaacccgacggtaccccgtgggaccgcccgtacgaacgggttcggacggtacgacggccgtacgtcccgaccgtcccgtagggccggacggtccggtacgggttcggggggaccttaaccggggttccgaacccggggtaccccgaaaccggggaacccccgtaacccccgtaaccgggttacccgtaaccccgttaccggttccccgtttaacccccgg

SEQ ID NO: 18736 - DNA, 750 bp, Homo sapiens
  misc_feature: GYAE6OF02JYA46.14.70.G04.1.454.CMB.1.raw
  modified_base (628)..(628): a, c, t, g, unknown or other
  misc_feature (628)..(628): n is a, c, g, or t
  modified_base (683)..(683): a, c, t, g, unknown or other
  misc_feature (683)..(683): n is a, c, g, or t
tcagcgtctagtaccacgaccggtgctcgatttagtgtagtgtgaagggaaaggggagagaggagcccagccctgggattttcgaggtgttttcacgtttggtgatcaggactgaacagagagaactcaccatggagttggctgaactggcttcttcgttgtggtctagttagtaaaaggtcgtccgtagtgtgtaggtgcgaacgttgttggagttcgtagggggaggtcgttacggtacgtaggtcccggttgggggtaccccgtaaaaccgttccttccgtacgtaacccgtaacccgtacgaacggttacgttccgttaccgtttcgactaactccttagacgtacctggtcggccgtcgggtaccccgcgacgtacgtcggaacgggacgggtacgtaggtacggtggtaacgtccgtacgtaacgtttacgtagtacggtaggtagggtaggttggtacgtaaactccgaacgtagtactttacggacgtcggtcgtccgttaggtcgggtaacgggtccccgtacgtaacccgaccgtcgtaccggtaaagtcgtaaactaccgtaaaccaaccactaacgtacttacgtactaccgactaaagtacacgttaacgccgtnaacgtcgacgtacgaccaaccgtctaagttaattcgtacgtagacccaagtacgngtaacggaacgaccggtcggaccgacgtacggtctaacggtcgacccgggtacgaccggcctaaccg

SEQ ID NO: 18737 - DNA, 714 bp, Homo sapiens
  misc_feature: GYAE6OF02FNKCG.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaagtggactggggtgtactgtaacagccctgctggcgagagggaccgagggcaccgtccgtccagggacgcccatcgctgcaacggtcgggccagacggtcgccccgtagacctgtaacggccaaagtgacgaccccaagactaggaccaaggtgggttagtgacggaccccgtaggacggacgcggtcgggcccgtcggtcccagggccacggcgtaccgtccggaccccgttgccgtcggcctggtcgtcgggttctacggccgtagtccggtacgtcccgacgtcggccgtcggtaccgcgtccgaccgtaacggtcggtcgaccgacccgacgtaaacggggcccggacccgacgtacccgtcgggacgtaccgcggtacgttacggagtccgacggtacccgactaccggtacgcccggtacgaccgggtacgtccgggtaggtcccgggggctaccgggttaccggaccggacccggaccggtaaccccgacccgttacccggtaccgttaaccctaccccgtttcttaccccccgg

SEQ ID NO: 18738 - DNA, 710 bp, Homo sapiens
  misc_feature: GYAE6OF02HHTKV.14.70.G04.1.454.CMB.1.raw
  modified_base (419)..(419): a, c, t, g, unknown or other
  misc_feature (419)..(419): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctggctagggacagggaccagaggccagtccagggaagaggacagaagccaatggacgtggggtgtactgtaacagacccgtgctggcgaggagggaccagggcaccgtcctcgaggcgcccatgctgcaacggtcggcgagacggtcgccccgtagaaccgtagaacggaccaacgtacgaacgaacccgaaacgacgacggaccgtaacggtgggttagcgtaacgaccccgtggacggacggtcggtaccgggccctacgggtcccgaggtccgacgtcgccgtccggtcccgngccgtcgcgtcggacgttcgggtacgtcggtacctaggttcggtcccgaccgtcgtccgccgtcgacgtccgacccgtaccgtacgtcggttaccgcgaacccggacggacccgggtacccgggaacccgtaccggtacccggttacggaccgtaccggtacgaccggttacggacgacccgagtacccgagtcccgtagaccgcggaacggtcgcggttggacggggtcacggtacgaccgacccggtaccgacccgaccctacgacctaccgtccgttacccgtccccg

SEQ ID NO: 18739 - DNA, 761 bp, Homo sapiens
  misc_feature: GYAE6OF02FZ00N.14.70.G04.1.454.CMB.1.raw
  modified_base (268)..(268): a, c, t, g, unknown or other
  misc_feature (268)..(268): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagcaatggactggggtgtactgtaacagccctgctggcgaggacgggaccaaggggcaccgtcctccgacgggacgcccatgctgcaagtccgggccaggnggtcgccccgtgaacctgaacggccaagtcgaacgacccgaagacgacggccgaaaggttggggttacgtggtaaccggacccctaggacggtacgcgtcggggcccgtcggtccccgaggccgacgccgccgtccggccccgtcgcgtcgcgtggccggtgggtcgtcggtccgtagtcggtccgaccgtacgtcggacctcgcgtcggccgaccgtaacggttggtacaccgaccgaacgaaccgggccgggtaacccgacggtaacccgtcggaccgtccgtaccgggtaaggttaccggaacggtaccgacggacccgtaacgtcccgtaaccggtcccggttcggaaccggggtaccgtcccggttaagggggccgggtacccgggtaacgggttccccggtaaaccgggaccccgtaaacccgggaccccgaacccccggttccggtaaccggttacccgtaacccgtttccccggttaaccccccg

SEQ ID NO: 18740 - DNA, 736 bp, Homo sapiens
  misc_feature: GYAE6OF02HNLFR.14.70.G04.1.454.CMB.1.raw
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (477)..(477): a, c, t, g, unknown or other
  misc_feature (477)..(477): n is a, c, g, or t
  modified_base (600)..(600): a, c, t, g, unknown or other
  misc_feature (600)..(600): n is a, c, g, or t
  modified_base (676)..(676): a, c, t, g, unknown or other
  misc_feature (676)..(676): n is a, c, g, or t
tcagcgtctagtaccacgaccggtgctcgatttagtgtagtgtgaagggaaaggggagggcgagttggtagatgccctctgggagagatcccgagggtgacagccatggaccctggaagggcctggctagggacagggacagagccagtccagggagaggacaggagccaaagtgggaactggggggtntaacgtgggtaaacaggccccttaggctgggccgaggaagggtaccaaggggtccaccggtcctacgaggggacncccgagtgcgtgcgaaacggtcgggaccagggaggtccggtccccnggtaaaacccngggaaccggaccgtaaaagtggaaacgaacccccgaaaggaccggaaaggcccgtaaaaggttggggttacgtacggaacggaaaccccgtggacgggaagccgttacgggccccgttgggtacccgaaggctaggcgcgttcggccccggttcgnggccttaggcgtggttcaacggttcgagttcgggcccgctacgtcgggctacgtcgtcgccgtaccacgtggttacgccggtaccgaacgaaacgggccggaaccgtaccggcgtaccggacnccgttacgacggtacggacgcgtacgaccttcggacctcggaccgtcgaccggtcgacgttcgggacgggttccgnggaccgtccggaacccgcgtaacccgtaacccggacctaggtcctaccggaggttccccg

SEQ ID NO: 18741 - DNA, 692 bp, Homo sapiens
  misc_feature: GYAE6OF02GK5E3.14.70.G04.1.454.CMB.1.raw
  modified_base (242)..(242): a, c, t, g, unknown or other
  misc_feature (242)..(242): n is a, c, g, or t
  modified_base (341)..(341): a, c, t, g, unknown or other
  misc_feature (341)..(341): n is a, c, g, or t
  modified_base (632)..(632): a, c, t, g, unknown or other
  misc_feature (632)..(632): n is a, c, g, or t
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaagtggacgtggggtgtacgtgtaacgacgccctgctggcgagagggaccagggcaccgtctccgagggacnccagtgctgacaggtcgggccaggacggtcgccctgaacctgaacgccaagtgacgaccaagacgacgcaaggtggttcgtgacgtacccgtggacggngtaccgcgggtcctacgggttcccgagggaccgacggtcggtccgtaccgggtcccccgtaggccgttcggtcgttcggcccggtttcgggtccgtcgggtaccgtacgttccgggtacccggtccgtacgtcggtacccgtggcgtccgaccgccgtaaggtcgtccgtcgaccggacgtaacgggccggaccgacgtccgaggccgtacgtcgaggtacgacggtaccgagtaccgagtccgtacgccgtcggtcgaccgtcggtacggcgggtaaggtaccggtaccncgggtaaccccgacgtacccggacccgttacgtaccgaccgttacctcccggttaccccg

SEQ ID NO: 18742 - DNA, 738 bp, Homo sapiens
  misc_feature: GYAE6OF02H8AEN.14.70.G04.1.454.CMB.1.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccaggggagaggacagagccaatggactggggtgtactgtaacagcctgctggcgagagggaccagggcaccgtcctccagggngcccatgctgcaaggtcggccaggaggtcncccgtagaacctgacggacctaatcgaacgaccaagacacggccaaggtgggttgagacgacccgtggacggcgagtcgggtccctggtcccgaggtcacggtcgcccgttaggcccctgtaccgtgtcgtggccgtgggtctacggccgtaggttccgggtccgtacccgtcggtaccggtccttcgggccgttacggccccgtccggtaaccgtttcggttaccggtaccgaccggtaccggaaaccgggtaccgggaacccggacggtacccgtacgggtaccggtcgtacggtcggtaacgggtacgaccgacggaccgtaccgtaccgtccggtaccgtcggggtccggacggtccggttaccgggtaggggaccggttacgggacccggtaacgggccccgtaaacccgggtcccgtaaccccggtaccgttaccggaccccttacccggttacgtttcccccgg

SEQ ID NO: 18743 - DNA, 811 bp, Homo sapiens
  misc_feature: GYAE6OF02IWO64.14.70.G04.1.454.CMB.1.raw
tcagcgtctagtaccacgaccggtgctcgatttagtgtagtgtgaagggaaagggggagagaggagcccagccctgggattttcaggtgttttcatttggtgatcaggactgaacagagagaaactcaccatggagtttgggctgaactggcttcttcttgtggctattgtaaaaggtgtccagtgtgaggtgcaactgttggagtcgtgggggaggcgttggtacagccgtgggggtccctaaaactctcctgtacaacctcaggacttcgccttcgcatctatcgccagtcggccgtcgggtcccgccagtacttccgaggggaacgggcgtgggtaggtgggatccgtactaaacgttaagtttaggtagggtaaggtggggtaaggttgggtacgtaagtacccgtaacgtaacgttaacgtttaaccggacgtaacgggtccgtttacgttggtaacgggtaacgggggtccccggtttacccgtaacccgtacctttacccgttacccgaaggaaacccgtaaacctaaaccgtttaccccgaaaactaaacccgtaactaaccgttttaacacccgttagaaaccttaaagtaccgaaaacctcgaccgttaggaccgaacggtcccgaaacgggtacccgaccgggtaaccctttagtaacctttaacgtggttaagacccgtaaaggacgtaacgtaacggaacccggtagggttaccccggtaagggggaccccttcccgggtttaagtaccggttaaccggggtccggggaaccccgtaaccgggggtaacccctttagg

SEQ ID NO: 18744 - DNA, 762 bp, Homo sapiens
  misc_feature: GYAE6OF02F2JLG.14.70.G04.1.454.CMB.1.raw
  modified_base (755)..(755): a, c, t, g, unknown or other
  misc_feature (755)..(755): n is a, c, g, or t
tcagcgtctagtaccacgaccggtgctcgatttagtgtagtgtgaagggaaaggggagggcagttggtagatgcccctctgggagagactccccgaggggtgacagccatcggaccctggaagggcctgggctagggacagggaccaggacgccagtccgagggagaggacagagccaagtcggacgtggggtgtactagtaacacgccctgcctcgggcgaggacgggaccgaggccgtacccgtccgtccggaagggacgccccgatcggcctcggacaacgggtccggcgtaacggtcggtaccgccccgttacggaccgtaggaacggtaccgaagtacggaaccgaaacccgaagaccgtacggaccgtaaggttcgggttcgtacggtaccgaaccccgtagggaacggcggaccggtccgggtcccgtacggtccgacgggcgacggtccgccgtccggtacccgtgccgtcggccgtcgccgtttgggtaccgtcggtcctacggtcggaccctccggtctaccggtccgtacgtccgtccggaccgtaccgtagggttcccgtcgtaacccgaccggtaaacccggaccggggaccccggtaacggaccggtccgtacggtaccgtccgtacgggtacgtacggacgtccgaaccgcggtccgtaccgcgtaccggcggaccgttagtccggaggtccgggacgacgtcccgaacgcgtaccgaccctaccgcgtacacggttccnccgttcc

SEQ ID NO: 18745 - DNA, 899 bp, Homo sapiens
  misc_feature: GYAE6OF02IRGJ9.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatcggaccctggaagggcctgggctagggacagggaccagagccagtccagggagaggacagagccaatggacgtggggtgtactgtaacacgcctgctggcgagacgggaccgagggcacccggtcctccgacgggacgcccgactcgctgacgaaggtccggccgaggtacgggtcgccccgtacggaacccgtacggaacgggtaccctaagtcggaaccggaaacccgaaaccgtaccgaacggtacccgaaagggttcggggtttagacggtaaccgtaccccggtaggacgggtaggaccggttccggggtcccccgttacggaccccggtacggaccggaacgggtccggtcccggccgggtcccccgttcggtccgttacggtccgttcggtcgggttcgggtcggttacggtacccgttcgtccggggtccggtaccccgtagggtcccggtccggtcgccggttcggtccccggtaccgttaaccggttcgggttaccggacccgacccggtaaccgggaaaccggggtcccgggtaacccggaacccgggttacccggtacgggtaacccggtaccgttaccgggtacgggttaccggaaccgggtaccgaaccgtacccggtaccgttccgacccggtcgtaccggtcgggtaccggccgggttacggcccggggtccggtaccggtacccggtaacccggtacccccggtaaccggacccccgaaccccggtaaccggttaccccggtacccgtacccggtttaccgtttcccccccggg

SEQ ID NO: 18746 - DNA, 680 bp, Homo sapiens
  misc_feature: GYAE6OF02G1FND.14.70.G04.1.454.CMB.1.raw
tcagcgtctagtaccacgaccggtgctcgatttagtgtagtgtgaagggaaaggggagggcgagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcggccagagtgccctgacctgaaggcaatgagaccaagacaggccaagtggtgtgacgaccctgaggagcgtcggccgtggtcccaggcgagcgacgtcggccccgtgcgtcgtctgcgtagggtctaggcctaagtcggtaccggtcccgacgtcggccgttagccgtcggtacccgtaccctaaagtcgggtttacgaccgtaacccggacgaaaaccgggccggggaaccccacggtaacccggtacggacgtaccgtacggacgttagggaacgccgaacgaccgaacgttcccgaacggtccgtacgggtaccgtaggtacccgtgggtaccggggtaccggacggttacccgaacggaccccgtaacggacccccgtaaaccccgtccggttaaccgtacctaccgttcccgttacccgg

SEQ ID NO: 18747 - DNA, 790 bp, Homo sapiens
  misc_feature: GYAE6OF02FOG1K.14.70.G04.1.454.CMB.1.raw
  modified_base (160)..(160): a, c, t, g, unknown or other
  misc_feature (160)..(160): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccaggganaggacagagccaatggactggggtgtactgtaacagccctgctggcgaggagggaccgagggcaccgtcctccgagggacgcccatcgcgtgcgaacggtcgggccaggacggtcgcccctagaaccgtagaacggaccaagtacgaacgaacccaaagaaccgagggacccgtaaagggttcgggttaggttgaccggtaaccccgtaggacgggaaggccggtcggggaccccggttcggtacccgagggcgacggccggtccggtacgggccccgtcggtccgtcggtccgtggtcggttcggggtcctcgggccctaggttcggtccggccctaggtcgggtccgtacgtcgcggtaccgaccccggtaagtcgggttaccgccgtaaccggaacggaaacccgggacccgggaacccgaaccggacccgtcgggacgccgtacgaacggttaggaacgtaccgaacgtcccggtaaccgtaccgaccgtacccggtcggaccgggtacgtccgggtacgggtaccggggtaaccgaccgggttacggaaccccggtaccggtaacccggaaccccgtaaaccccgtaccggtaccggtaccccgtaccgttacccgttaccccgg

SEQ ID NO: 18748 - DNA, 802 bp, Homo sapiens
  misc_feature: GYAE6OF02H5PKO.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctaggacagggaccagagccagtccagggagacggacagagccaatggactggggtntactagtaacgacgccctagctggacgaggacggaccgagggcacccgtcctaccgagggacgccccagtcgcctgacgaacggtccgggaccagggacggtccgcccccgtagacccgtggaaggcccaaagtcggaacgaacccaacggaacgacggaccgtaaggttcgggtttagacggaccggtacccccgtaggacgggacggtccgtcggggaccccgtcggtaccccgaaggccgacgccggccgtccggtcccgtcgtccgtcgcgtcgacggttcgggtccgtacggtcccgtaagtccgggtacccgtccgtacgtcggtcccgtgtaccgccggtcccgaccgtacggttacggtccgtaccgaacccggaacgtaacccggggcccggaacccgtaccggacccgtcggaaccgtcccggtacggtaacggttacgggacttaccggacggaccctaacgtcccgtacgtaccggtaccgggtcgggacccgtccgttcgggggtaccgggtcggaacccggtaccggaacccggtaacccgaacccggttaccccgaaccccgtacgtcccgggtaaccttcccggtaacccgtttcccccgg

SEQ ID NO: 18749 - DNA, 752 bp, Homo sapiens
  misc_feature: GYAE6OF02IJD3F.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgccctctgggagagactcccgaggggtgacagccatggaccctggaagggcctgggctagggacagggaccagagccagtccagggagaggacagagccaatggactggggtntactgtaacagccctgctggcgagacgggaccagggcaccgtcctcgagggacncccagtgctgactaaggccggcaggaggtccgccctagaacctagaacggaccaagtacgaacgaccgaaacggacgaacggaccgtaaggtgggttacggtacgtaaccgtaccccgtagggaacggtacggtccgtccgggacccgtcgggtacccgagggtccgacggtaccgtccggtccggtcccgtcggtcgtcgcgtggtcgtcggtcgtcgtacgtagtcggtaccgccgtacgtcgcgtcgcgtacggcctaccgtacgtcggtacgaccgaccgaacggtaacggacccggaaccgtaccgtacccggacggtaccgtaccggtacgtaacggttaacgggaacgtaccgtaaccggaccgtaccgttaccgaaccggtccggtaccgggaccgggtacgtccgggtaagggtccgggtaaaccgccgggtaacgcccggtaacccggaacccgacccgtaaccccgtaccgtaccgtaccgtcccggttacccgttaccccg

SEQ ID NO: 18750 - DNA, 621 bp, Homo sapiens
  misc_feature: GYAE6OF02G8XFZ.14.70.G04.1.454.CMB.1.raw
  modified_base (350)..(350): a, c, t, g, unknown or other
  misc_feature (350)..(350): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccaggaggtcgcccctgaacctgaaggccaatgagaccaagacaggccaagtgggttgtggagacccctgaggagctgggcctggtcccaggcngcgctggccctgctgctgctgggtctggcctagtcggtcgcccgacgtcggcctgctcggcgcccgaagttcggttcgccaaccggcgaaaccggccggggaaccccacggacccgtgggacgcccgtcgaggttcggaacgtcgacgccgacgtaccgacggcccgttaggccgggtacgccggtacggtcggggggaccgtagggtccgaacggtaccccgaacgggaccccgaacccgtaccgtacgtcctaccgttcgttaccccgg

SEQ ID NO: 18751 - DNA, 785 bp, Homo sapiens
  misc_feature: GYAE6OF02FMN4T.14.70.G04.1.454.CMB.1.raw
  modified_base (189)..(189): a, c, t, g, unknown or other
  misc_feature (189)..(189): n is a, c, g, or t
  modified_base (639)..(639): a, c, t, g, unknown or other
  misc_feature (639)..(639): n is a, c, g, or t
  modified_base (681)..(681): a, c, t, g, unknown or other
  misc_feature (681)..(681): n is a, c, g, or t
tcagcgtctagtaccacgaccggtgctcgatttagtgtagtgtgaagggaaggggagggcagttggtagatgcccctctgggagagatccccaggggtgacagccatggaccctggaaggcctgggctagggacagggaccagagcccagtccagggacgaggacagagccaaagttggactgggggtntacgtaggtaacaggccctgctggcgaggagggaccaggggccacgtcctacgagggacgcccagtgctgcaagtcgggccaggacggtgcccctagaaccctggaaacggcgaaacgtgaacgtacccgaaagacctaaggacccgtaaaggttcggggtataggacgtacccctagggaacggtaagccgtagggtcccctagggtacccgaagggccgacgccgtcgtccgggtccccgtggtcctcggtaccgttcggccgttttacggggcctacgggtaaccgtcggtccgggttaccgtcccggtacttccggggaccgtcgtaccgtcggccgtaacccgaaggtttaccggtcgtcccgaaacccggacgtaaaaccgggacgggggtaacccacgggtccggacggtacgccttacggtaaggttacggacggtacgacnccgggaacttaccgaggtaccgtggaaccggttcgtaccggngggtaccgggggtaccaacggggttccgaaaccggtcccggtaaaccggtaaccccgaaccccggtaacgtccggtaacccggtaccttccccggttaaccccg

SEQ ID NO: 18752 - DNA, 951 bp, Homo sapiens
  misc_feature: GYAE6OF02IYMFK.14.70.G04.1.454.CMB.1.raw
tcagcgtctagtaccacgaccggtgctcgatttagtgtagtgtgaagggaaagggagggcagttggtagatgcccctctgggagagatccccaggggtgacagccatggaccctggaaggcctgggctagggacagggaccagagccagtccagggagaggacagagccaatcggactggggtgtactgtaacagccctgctggcgagaggaccagggcctaccgtcctaccgacgggacgcccagtcgcgtcgacaacggtccgggaccaggtacggtaccgtccccccgtacggaaacccgttacggaaacggacccgaaagtaccggaaaccgaaaccccgaaacggaaccgacgggaaccccaaagggttcggggttttacggtacggtaacccggtaaccccccgttaggggtaacggggtaaaccggtcccgggtttaccgggggtacccccgttaccggggttacccccgaaccggggacctaccggtaccgggcccggttacccgggtccccccgtaggtcccgtacggtccccggttcgggtcccgtttcgggttacccgttacggtacccgtacggttcccggggtacccgtaaccggtacccggtttcgtcccggttacccgtccgggtacccggaccccgggtaaccccttaaggggttacccggttaccggaccccggttaaacccgggaaccccggaaaaccgggaacccggggttaccccgaaacggtaccccgttacgggacccgtcccggtacggtaacggttaccggaacgttaccgaccgtaacgtacccgtacccgtaacgcccgtaacgccggactccgggttacggtaccggggccgtaaccgggccgtaaaccggaacccccggaaccggaacccctaaccccggtaccttaacccggtaacccttcccggtacccgttaccccccgg

SEQ ID NO: 18753 - DNA, 895 bp, Homo sapiens
  misc_feature: GYAE6OF02FYCQ5.14.70.G04.1.454.CMB.1.raw
  modified_base (79)..(79): a, c, t, g, unknown or other
  misc_feature (79)..(79): n is a, c, g, or t
tcagcgtctagtaccacgaccggtgctcgatttagtgtagtgtgaagggaaaggggagggcagttggtagatgcccctntgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgagggacgcccatcgctgcgaaggtcgggaccaggacgggtcgcccccgtgaacctggaacggtccaatagaacgaaccaaggaacaggaccgaaggttgggttgtaggacgtaccccgtaggaggacggcgtcggggcccgttacggcccgtacgggcgacggcgcgtcggccccgtgcgtcgtcgtcgtcgtcgggtcgtcggccgtacggtcggtccgcccgtacgtcggtccgtggtccgtcggccgtacccgtacggttcgggtcgtaccgtaacccggaccggtaaaacccgggtacccggggaaccccgaaccggtaccccggttccgggaacccggtacccgttaccgggttaacgggtttaaccgggaaccgggtcccggtaaccggtaccccgggtaaccgttaacccggacccgggtaccccgggttaccggggtaacccggggtaccgggttcccccggggtttacggggggtttaacccggggggtacccgggttaaacccggggtttaaccccggggaaaccccccggggtttaaccccccgggaaaaccccgggacccccccggttaaaacccccccgggttacccggttaccccgggtttaaccccgggttaccccgttttacccccggttttaaccccccccgggg

SEQ ID NO: 18754 - DNA, 836 bp, Homo sapiens
  misc_feature: GYAE6OF02FRWXT.14.70.G04.1.454.CMB.1.raw
  modified_base (292)..(292): a, c, t, g, unknown or other
  misc_feature (292)..(292): n is a, c, g, or t
tcagcgtctagtaccacgaccggtgctcgatttagtgtagtgtgaagggaaaggggagggcagttggtagatgcccctctgggagagactccccgaggggtgacagccatggaccctgggaagggcctgggctagggacagggaccagagccagtccagggagaggacagacgccaatggactggggtagtactagtaacagccctgcctgggcaggacggccagggccaccggtcctccgagggaccgccctatcgacgtcgacaagggtccggaccaagggtacggtccnccccgtaggaaaccctgggtaaacggccccaaagttacggaaccgaaaccccgtaaagaccgaacgggacccgtaaagggttgggggttttacggacgggtaaccgtaacccccggtaggacggggtaacggccggtcgggccccgttccggtaccccgagggccgtacgggccggtaccgtccgggcccccgttggcccgttcgtcgtacggttccggtttcgggtaccggttacgggtccctaagggtttcccgggtacccgtcccggtacgttccgggccgtttccgccgttacccggtccgtaccccgtaggttccggttacgaccgtaacccggacgaaccgggacccgggtaacccacggccccgtagggacccgtaccgtaacgggtcggttacgaacgggaccgtaccgtacccggaccgttaccgggaccgtccgtacgggggaccgtggtacccgtggggacgggtccggtacggaccggaccgacccgaacggacccctaccggacgtcgacctccgttacccgttacccccg

SEQ ID NO: 18755 - DNA, 804 bp, Homo sapiens
  misc_feature: GYAE6OF02HGI7J.14.70.G04.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacgcccatgctgcaagtcggccaggaggtcgcccctagaacctgaacgccaatgacaccaagacaggccaagtggttgtagagaccccgtgaggacgcgtcgggccctcggtcccgaggccgagccgcgtccggccctcgcgtcgcgtcgtcgtcgggtctcggtccgtagttcggtacccgccgtacgtcggccctgccgtcggaccgtacccgaagttccgggttacgacccggacccggtaacggaaacccgggacccggggtaaccccgtacccgggtaaccccggtccgggtaaacgtccccggttaccggttaaacgggtttacggggaaaccggtccggtaaacccgggacccggtaacccgttcccgggttaaccggcccccggtttacggggacccgggtaccgggacccggtttccgggtaccgggggggtcccgtaaccgggggttcccggaacccggggtaaccccctaaaccccgggggtaaccccctaaaccccccggtaccggtttaacccccggttaccggttaccccctcccggttttaaccccccccgg

SEQ ID NO: 18756 - DNA, 876 bp, Homo sapiens
  misc_feature: GYAE6OF02IJCR1.14.70.G04.1.454.CMB.1.raw
tcagcgtctagtaccacgaccggtgctcgatttagtgtagtgtgaagggaaaggggagggcagttggtagatgcccctctgggagagatccccagggtgacagccatggaccctggaagggcctgggctagggacagggaccagagccagtccagggagaggacagagccaagtggacgtggggtgtactgtaacagccctgcgtggcgaggaggaccagggcaccgtcctcgagggacgcccatcgctgacaacggtcggccaggacggtcgcccctaggaccgtaggaacggaccaagtacgaaccgaacccaaaaggaccgtaacggaccgtaaaggggttcgggttttagtacgggaacccggtaccccggttagggaacgggtaccggtccggttaccggggtcccgttaccggggtaccccgaacggggcccaacgggccggttccggtcccgggtccccgtgggttactcggtccgttcggtacccgggttcgggtaccgtcggccgttaaggtccggtaaccgtcccggtagtccggtaccgtttcggccggttaccgtcccggtaaccgttaggtttaccggggttacaccccggttaaccgaacgggtaaacccgggtccccggggaaccaccgggtaccccgacgggtaacccgtccgtaacggttacgggttaaccggaaccggaccggtaaccgtacccgaccggttaaccgtcccggtacgggaccggggttacccgtacgggttcccggtacggggtcgggtaacgggtacccggtaaccggaccccggtaaacccgggacccgttaacccccctacccggtactttaacccggcccttaccgtttacccgttacccccgg

SEQ ID NO: 18757 - DNA, 832 bp, Homo sapiens
  misc_feature: GYAE6OF02G36CJ.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaaggcctgggctagggacagggaccagagccagtccagggagaggacagagccaatggactggggtgtactgtaacagccctgctgtcgagaggaccagggcaccgtcctccgagggacgcccatcgcgtagcgaacggtccgggaccaggacggtcgccccgtaggaacctggaacggccaatcggaacgaacccaagacgacggacctaaggttggttagtcggacgaccccgtggacggacgtccggtacgggtcccgtacggtccccgacgggccgacggccggtacccgtccgggtcccccgttaggtcccggtcggtccgttacgggccggtttacggggttccgtaacgggtcccgtaacggtttcccggtacccggtaccccggtaacggtttccgggtacccgttcggtacccggtaccggtacccgtaccccggtaaggttcccgggttacgacccggacggtaaccggaaacccggggtacccggggtaacccgtaaccggtaccccggtagggacccggtcccgttaacgggtacggttaacgggaacgtacccggtaaaccggttccgtaaccgtaccgtaccggtccgttaaccgggcggtacggttcccgggtagggtccgggtaccggaccgggttaacgacccgtacccgtaaccggaccccgtacccgtcgtacctccgtaccgttccgttaccccg

SEQ ID NO: 18758 - DNA, 637 bp, Homo sapiens
  misc_feature: GYAE6OF02JXAK4.14.70.G04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (452)..(452): a, c, t, g, unknown or other
  misc_feature (452)..(452): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (594)..(594): a, c, t, g, unknown or other
  misc_feature (594)..(594): n is a, c, g, or t
  modified_base (627)..(627): a, c, t, g, unknown or other
  misc_feature (627)..(627): n is a, c, g, or t
tcagcgtctagtaccacgaccggtgctcgatttagtgtagtgtgaagggaagggagggcgagttggtagatgccctctgggagagactcccgaggggtgacagccagtcggaccctgggaagggcctgggctacggggacagggaccaggtacgccctagtcccaggggagacgggacaggacgccaattgggacgtgggggtntacgtggtaacaggccctggctgggcgtggagggacctaggggcacccggtcctcgagggcnccctatgctgctacgcggcagnggtccccganactgaacggtccaatcgacgaccgaagaccgaggaccacggtgggttcncggagtacccctaggacggacgtcgtcggggccctggtacccgaggccgtaggccgtcgtcggccccgttggcccttggaacgtcggtactgggttcacgggacncggttcggaaccgtccggagcggacctgacgtcgacgcccgtancggtancgcncggaacgcgggttccacgtcngggactcgctggtcggtacncgacgccgntaccgngtccgngtcgcnccgtaggcggaccgtgtccnccggaacgccggacccgaccacgtccgaactcnccgggttccc

SEQ ID NO: 18759 - DNA, 791 bp, Homo sapiens
  misc_feature: GYAE6OF02ITJHT.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaaatggactggggtgtactgtaacagccctgctggcgagagggaccagggccaccgtcctaccgagggacgcccatgctgcaacgtcgggaccaggaggtcgacccctgaacctgaacggacaacgtagacgaacccgaagaaccacggaccgtaaggtgggttagtacggacgacccccgtaggagggacgcgtaccgggtccctacgggtcccaacggtcgacgcggtaccgtacgggcccctcggctacgccgtaggccgttacgggtccgtacgggaccgtaagttaccgggccgaccctacgtaccggccgttcgccgttacggcccgaccccgtaacggttacgggttacgacccgaaacccggtaccgaaaacccgggcccggggaaaccccgaaccggtaaccccgtacgggaccgtacccgtaccggaaagggttacggaacgtaccgaacggtaccccggtaacgtccccgaaaccgtcccgtacgggtacccgggtacggcccggttagggtacgggggtacccgacgggttacccaaccgggacccccgaaacgggtaccccgaaacccccgtaccgtacggtacccctaccgtacctttaaccccgg

SEQ ID NO: 18760 - DNA, 741 bp, Homo sapiens
  misc_feature: GYAE6OF02H84B4.14.70.G04.1.454.CMB.1.raw
tcagcgtctagtaccacgaccggtgctcgatttagtgtagtgtgaagggaaaggggagggcagttggtagatgcccctctgggagagatccccgaggggtgacagccatcggaccctgggaagggccgtgggctagggacgagggaccagagccgagtccgagggagaggacagacgccaagtggacgtgggtgtacgtgtaacgcgtcctgcgtggcggagaggaccgagggctacccgtcctcgacgggacgaccgatcggactacgacgtaacggtccgggacgaggacggtccggaccctacggaacctaggaacgtacgtaacgacggaacgaacccgaaggaaccgacggtaaccgtaagggttcggttggaacgtccggaacccgtaggacggtacgccggtaccggccgttccggacccgacggccgtacgccggtaccgtccggtcccggtgtccgttcgacgtcggtaccggtcgggtcgtaccggtcgtcggtacggtcccgtaccgtcggtcggtcccgtgtaccgtccgaccgaacgaggttccgtcggaccgacgacggaaaccggccgaccgacgacgacgtccgacgtcgtaggtacgaacgcacggccgaacgtcgtaccgcggtacgaccggacgtccgggtgaccggggactacggtaccacccggacccgaaccgaccctaccggaaccgtttcggacccttaccgttccgttacccccgg

SEQ ID NO: 18761 - DNA, 943 bp, Homo sapiens
  misc_feature: GYAE6OF02H1O0D.14.70.G04.1.454.CMB.1.raw
  modified_base (220)..(220): a, c, t, g, unknown or other
  misc_feature (220)..(220): n is a, c, g, or t
tcagcgtctagtaccacgaccggtgctcgattttagtgtagtgtgaagggaaaggggagggcagttggtagatgcccctctgggagagatccccagggtgacagccatggacccctggaagggcctgggctagggacagggaccagagccagtccagggagaggacagagccaatggactaggggtgtacgtgtaacagccctgctggcgagacggaccngggcaccgtcctccgagggacgcccattgactgtacgaacggtccgggccaggacggtcgacccctagaacccgttggaacgggacctaacgtggaaccgacccgtaagaaccgaaggacccgtaaagggttgggttacggtaggaaccggtaccccgttgggaacgggtacgggtacccgttaggggggtcccccgttccggggttaccccgacggggtacccgaacgggtccggtccggttccgggtcccccgttaggcccgtttcggtccgttacggtccggtttacgggttccgtaccgggtccgtaacggtccgggttacccggacccgttacggtccgggtcccgttcggtcccgttaggaccccggttaccccgttaacgggtcggttaccgtaacccggttacccggaacccgggtaaaaccggggtaccccgggtaaaaccccctccggggtaaacccccgtttagggaccccgttacccggttcggtaacggggtacccggtaaacgacccggttaaccgggttacccggaaccgttaccccgaacgggttaccccgtaggggaccccgggtcggtaccgggtttccggggtaacggggtcccggttaacggggtccccgtaaccgggaccccggttaaaccccggaccccgttaacccccgttacccggtaacccgttcccggttaccccgtttaccccgggttaccccccg

SEQ ID NO: 18762 - DNA, 897 bp, Homo sapiens
  misc_feature: GYAE6OF02FN4B8.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctgggaagggcctgggctagggacagggaccagagccagtccagggagaggacagagccaatggacgtggggtgtactgtaacagccctgcgtggcgaggacgggaccgagggtccaccgtccctaccgagggtacgcccatcgcctgaccgaacggtccgggaccgaggacgggtccgtacccccgtaggaaaccccttggaaaccgggacccaagttacggaaacggaccccgaaaaggaccggaacgggacccgaaagggttcgggtttaggtaggtaaccggtaacccccgtagggtaaccgggtaaggtcccggtccgggggtaccccgttccggggttaccccgacgggtaccgaacgggcccggacgttacccgggacccccgtacggtcccgtacgggtccgtacggtaccggttcggggttacctcgggtacccgtacgttccggggttcccgaccccggtaacgggtccggtccgttacggtccctccggacccggtaaccccgttaaaggttccgggttacgacccgtaacccgggtaccgaaaaccggggccggggaaacccctaccggtacccgttaccgggaccgtacccgtacggttacggtaaccgggaacgccggtaaccggacccggtaacgtcccgaacggtcccgaaccggggtcggtaccggtcggtacgggccgggttaccggcggttaccggacccgaaccggttaacccggacccctaacccggtaccgtaccgtaccgttcccgtcccgttacccccgg

SEQ ID NO: 18763 - DNA, 718 bp, Homo sapiens
  misc_feature: GYAE6OF02IJXJQ.14.70.G04.1.454.CMB.1.raw
  modified_base (237)..(237): a, c, t, g, unknown or other
  misc_feature (237)..(237): n is a, c, g, or t
  modified_base (291)..(291): a, c, t, g, unknown or other
  misc_feature (291)..(291): n is a, c, g, or t
tcagcgtctagtaccacgaccggtgctcgatttagtgtagtgtgaagggaaagggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggancccatgctgcaagtcgggccaggaggtcgcccctgaacctgaaggccaaatganacccaagacaggaccaaggtgggttgtgacgaccccgtggaggagcgtacggcccgtcggtcccgaaggtcaggccgcgtcggccctgcctgcgtgcgtgggtctcggcagttcggtccgacccgtagtcggtcctcggctccggccgtacctaacggttgggttacgccgtaacccggaccggaaacgggtaccccggggaacccgtaaccggacccggttacgggtaccgtacccgtacggtacgggtttacgggaacgcccggtaacggtcccggaacgttacccaaccgggtcccgtcggggaccggccggtaccggttcggggtccgggggaccgttaccggggaccgtaaccggtaccccggaaaccggaccccgaaccccgtaccgtacccggtacctacccgttcccggttacccccgg

SEQ ID NO: 18764 - DNA, 679 bp, Homo sapiens
  misc_feature: GYAE6OF02JK81B.14.70.G04.1.454.CMB.1.raw
  modified_base (159)..(159): a, c, t, g, unknown or other
  misc_feature (159)..(159): n is a, c, g, or t
  modified_base (185)..(185): a, c, t, g, unknown or other
  misc_feature (185)..(185): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (669)..(669): a, c, t, g, unknown or other
  misc_feature (669)..(669): n is a, c, g, or t
tcagcgtctagtaccacgaccggtgctcgatttagtgtagtgtgaagggaaagggagggcgagttggtagatgcccctctgggagagatcccagggtgacagccatggaccctggaagggcctgggctagggacagggaccagagcccagtccaggganaggacaggagccaatggactggggtntacgtgtaacgcgaccgtcgacgtcggcggagacgggtacgacgggacgtacccgtccgtccgacgggacggaccctgtacgcgtcgcgaaaccggcggtccgagtaggtcgccccgtgaacctaggacgcgaactcgagacccgaagctaacgacaacggtggtcgtagcgacccgttaccgagacggctaccggtccgcgttcccgaacggtccgagaccggtcgccgttccccgcgngttccgtanccggtccggtgtcgggctccgtaaacgtcggcggacccctgcggcgttggcgtacgcgacccgtacgttggtcgcgtacgacgacggacggacccgtacgaccgtacgaccgtcgacgtacgacggttacgacctggaccgaactcccgaacgtcgacgccgcggtacgttccggaggttccgacgttaggaccccgacgtaccggaacccgtaccgacccgtagtcccgttacncccggttccg

SEQ ID NO: 18765 - DNA, 804 bp, Homo sapiens
  misc_feature: GYAE6OF02JKZCV.14.70.G04.1.454.CMB.1.raw
  modified_base (156)..(156): a, c, t, g, unknown or other
  misc_feature (156)..(156): n is a, c, g, or t
tcagcgtctagtaccacgaccggtgctcgatttagtgtagtgtgaagggaaaggggagggcgagttggtagatgcccctctgggagagatcccagggtgacagccatggaccctggagggcctggctagggacaggaccagagccagtccaggagnggacagagcaaatggacgtggggtgtacgtgtaacagccctgctggcgagagggacagggcaccgtctccgaggacgccatgctgcaaacggtcgggaccaggacggtcgcccctagaaccgtgaacggaccagtagaacgacccaagtacaacgggactaacggtgggttcgtacggacgacccgtaggaacgtaggccgtacgggtcccgtcgggtacccgaggaccgtacggccggtaccgtccgggtaccccgtggtccgtcggtacctcggcccggtttgggtccgtcgggacctacgggtacccggtcccggtaccctcgggtacggtccgtcggtccgtaccggtacccggtaccgtaaccggttccggttacggccggtaaccggaaccgggaaaccggtaccggggtacccggaccggtacccggtaccggaccgtcggtaaccggttaccggttaacgggtaacccggtacgtaacccggtaccggtaccgtaccgtaaccggtacccggtaccggtacgggtaaccgtccggggtaccgggtacgggtcgggtaaccggtcgtacccggaaccggtaacccggaccccgtaacccggtacccgtaccggtcccgttaacggtacccgtttaccccgg

SEQ ID NO: 18766 - DNA, 797 bp, Homo sapiens
  misc_feature: GYAE6OF02G7BF6.14.70.G04.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
tcagcgtctagtaccacgaccggtgctcgatttagtgtagtgtgaagggaaaggggagggcagttggtagatgcccctctgggagagatccccaggggtgacagccatggaccctggaaggcctggctagggacagggaccagagccagtccagggagaggacagagccaaatggacgtggggtntactgtaacagccctgctggcgagaggaccagggccaccgtcctccgagggacncccagtgctgacaacggtcggccaggacggtcgcccctagaaccgtaggaacggacctaaggtcgaaccgaacccaaaggaccgaacgggaccgtaagggttcgggttaggtacggaacccggtaaccccggttagggacgggtacgtccgggttccgggtccccgttacgggtaccccagggaccgacggccgttaccgtcccgggtccccgttagtccgttcggtccgttcggtacgggtttcggtaccggtcgaccggtacgtcccgggttaccgcccgttaggtccggtacccgtggtaccgtccggacccgtaccgttacggtcggttaccgaccgtaaccggaacgggaaacccggtaccggggaccctaccgggtaccggacggtaaccgtccgtacggtaagtaccgggaccgtacgacgccgttaaccgacgtacccgtggtaccgcgtaccgggtcggtagggccgggacgttaccggacgacccggaaccccgtaacgggtaaccccaccggtactccggtaacctcccggttacctttacccccgg

SEQ ID NO: 18767 - DNA, 759 bp, Homo sapiens
  misc_feature: GYAE6OF02FGPSX.14.70.G04.1.454.CMB.1.raw
  modified_base (186)..(186): a, c, t, g, unknown or other
  misc_feature (186)..(186): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtntactgtaacacgccctgctggcgagacgggaccagggccaccggtcctccgagggacncccancggcctgccaaggtccgggaccaggacggttcgcccccgtaggtaaccgtacggaacgaccgaacgtacgaaccgaacccgaacgacgaacggtaccgtaagggttcgggttaggtacggtaaccgtacccgtaggacggacgtccggtccgggtcccggtaccgggtacccgacggtaccgacggtccggtccggtccgggtcccgtcggtccgtcgtcgtcggtccggtcgggttccgtcggaccgtacggttccggtaccgccgtacgtccgtcgtcgcgtcgtccgaccgtacgttcggtccgaccgaccgacggaaccgggtaccggaaccgaccgtaccggtacgacgtaccgtacggtacgtacggacgtccgacgaccgtacgtaccgacgtccggcggtccggacggtccggcgggtacgggtaccggtaccggaccggtaaccggacccgaaccggaccccgtaaccgtccgtaccggtacccttccgtcccgttacccg

SEQ ID NO: 18768 - DNA, 787 bp, Homo sapiens
  misc_feature: GYAE6OF02HUZLZ.14.70.G04.1.454.CMB.1.raw
tcagcgtctagtaccacgaccggtgctcgatttagtgtagtgtgaagggaaagggagggcagttggtagatgcccctctgggagagatccccgaggggtgacagccatggaccctggaagggcctgggctagggaacgagggaccaggagccgtacgtaccgagggaggaggacgagagaccgaagtggacggtgggtgtacgtagtaacgacgccgtgtcgtggacgaggacggacgacggaccgtaccgtaccgtacggagggaccaccgtagtcgtcgtacgtacgaaccggtccgggtaccgaggtacggtcccggtacccgtaacgaccgtaacggaaccggtacctaacgacggaaccgaacccgtaacgaacggaccgtaacggaaggttcggggttacgtacggtaccgtaaccccgtaggacggtacgtccggtaccggtcccggtaccggtacccgtaacggcgtacggtcccggtacggtccccggtccgtacgtccgtcgtacggtcgtcggttcggtccggtacgacgtacgtccggtccgaccgtagtccgccgtcgtccgtacgacccgtcgtaacggtgtcgaccgaccggaacggacccggacggacccgtaccgacgtacgcgtcgtaacgtaggacgacgtcgaccgtacgtccgacgtcccggatccggccggtaccgtggtccgggtacgcgggtaccggaccgaaccggttaaccccggaccgtaccccgaccggtacacccgttacgttccgtcccgttacccg

SEQ ID NO: 18769 - DNA, 726 bp, Homo sapiens
  misc_feature: GYAE6OF02JJVGY.14.70.G04.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagcgtctagtaccacgaccggtgctcgatttagtgtagtgtgaagggaaaggggagggcagttggtagatgcccctctgggagagatccccagggggtgacagccatggaccctggaagggcctgggctagggacagggaccagagccaggtccagggagaggacagagccaatggactggggtntaactgtaacagccctgctggcgagagggaccagggcaccgtcctccgagggacncccatcgctgccaagtcggaccagacggtcnccctagactgaaggccaatgacgaccaagacgacgacgaagtgggttactggaacgtacccctaggtacggacggtcgtcgggtacccgtcggtacccgaggccgacggtccgacgtcgggcccctagtccgngtcgtcggcgtcgggtcncggtccagtcggtccgcccgtagtccgccgtcgacgtcgaccgtccggaacttcggtacgaccgaccgtaccgaacgggcccgggaaccaccgaccgtcgacgccgtactacggtacgcgtaccgaaccggtccgaaccgtacccggtagtacccgtacggggacccggtacggtaccggggtttaggccgggggttaaccgaccgggttaccggaaaccccgggttacccgtaaaccgggaccccccttaaccggtacccggttaaccggtttaccgtacccgttcccgggttacccccgg

SEQ ID NO: 18770 - DNA, 714 bp, Homo sapiens
  misc_feature: GYAE6OF02GKIK9.14.70.G04.1.454.CMB.1.raw
  modified_base (590)..(590): a, c, t, g, unknown or other
  misc_feature (590)..(590): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggccaccgtcctccgagggagcccatgctgcaaggtcgggccaggaggtcgcccctagaacctggaacggaccaagtgacgaacccaagacacggccaaggtggttgtggacgacccgtgacggagcgtcgggcctcgggtcccagggcacggccggccgttcggcccctggctcggctcggcgtgggtcgtggccagtcggtccgcccgagtcggtcctcgacgtcgccgtcccgtaagtcgggttcgaccgtaaccggaccgtaacgggacccgggaacccgtaccggtaccccgggtacgggaccggtccctacggttacggttaacgggacggacgtaccggccgtaacgtacccggcgtacccggngacccgggtacgccggttacgggtacggggcccggtaacggggttaccgaaccgggtacccgaaccccggtaccccgaaacccggttaccgtaccgtaccccgtaccgtccgtttaacccccgg

SEQ ID NO: 18771 - DNA, 875 bp, Homo sapiens
  misc_feature: GYAE6OF02HHQLG.14.70.G04.1.454.CMB.1.raw
tcagcgtctagtaccacgaccggtgctcgatttagtgtagtgtgaagggaaaggggagggcagttggtagatgcccctctgggagagatcccccgaggggtgacagccatggaccctggaagggcctgggctagggacagggaccagagccagtccagggagaggacagagccaagtaggacgtggggtgtactgtaacacgtccctgctggcgagacgggaccgagggccaccgtccctccgagggacgcccagtgctgacgaacgtccgggaccaaggacggtccgacccccgttacgaacccgtacggaaacggacccaaagttacgaaccgaaccccgaaaaggaaccgaacggtcccgtaaaacgggttggggttaacggtacggaacccggtacccccggttagggaacgggtccggaccgggttcccgggccccgttaccggggtacccccgaagggtaccggacggtccccggtacccggttccggccccccgttggtaccccgtgtcccgttcggtccggttccgggttaccggtccggacccgttagggtccccgggtacccggtaccccgtacgggtccggtacccgtcggtcccgtacccgggtacccgtaaccccgtaacgggtttcgggtacccgtaaccccggaaccggtaaccggaaacccgggtacccgggaacccggtaccggacccggttaccgggacccgtccgtaccggtacggtacggacgacgtaccgaccgtacaccgtaccggccgtacggcggtccgccggttacgggcgggacccgtaggtaccggacccgaacccggtaacccgaccccgaacccgtaccgtaccgtaccgtccctccgtacccccg

SEQ ID NO: 18772 - DNA, 636 bp, Homo sapiens
  misc_feature: GYAE6OF02GJ90S.14.70.G04.1.454.CMB.1.raw
  modified_base (285)..(285): a, c, t, g, unknown or other
  misc_feature (285)..(285): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagttggccagagtgcccctgaacctgaagccaatganaccaagacaggccaagtcgggttgtaggagaccccgtggacggagcgtcgggccctggtcccaggccaggcgctcggcccctgcctgctcgtcgtcgggtctggcctagtcggtcgaccctagtcgccgtgcgtcgccgtcccgaagttcggtcgccgtaccggaccgaaacggccgggaacccgacggacccgttcgggacctccgtcgtagtacggaacgcgacgcccgtagtcccgaacgcccgtcgaccggtcgccgttacgggtcggggccgtaacgggttccaaccggtacccgaacggaccccgaaccccgtaccgtaccgtaccgtaccgtccgttaccccgg

SEQ ID NO: 18773 - DNA, 733 bp, Homo sapiens
  misc_feature: GYAE6OF02H0T6D.14.70.G04.1.454.CMB.1.raw
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
tcagcgtctagtaccacgaccggtgctcgatttagtgtagtgtgaagggaaagggggagggcagttggtagatgcccctctgggagagatccccgagggggtgacagccagtggaccctggaagggcctgggctagggacacgggaccagagccagtccagggagaggacagagccaatggactggggtatactgtaacngccctgctggcgagacggaccagggcaccgtcctcgagggacncccatcgctgacaaggtccggcaggacggcgcccctagaccgtgaacgccaagtcgaacaccaagacgacgacctaaggtcggttanacgacgacccgtagacggngtcgtaggccctcggccaggcgagcgcgtcgccctgcctcgctacggcgtcgggtcgtccggtcgacgtcggtaccgacccgtagtccggacgtccgcgtccggaccgtaccgtaacggttcggtccgaccggaaccggtaacggaacccgggtacccgggtaaccccgtaacggtacccggtacggaaccgtccggttaaccgcggttaacgggaacgacccggtaacgtcccgaacgttcccgaaccggtccgtaaggcccgggtacgtaccgttcggggtacgggaccgtaaccgggtacgacccggttaaccccggaaccggtaccccctaacccggtaaccgttaccggttacccgttacccgtaccgttaacccccgg

SEQ ID NO: 18774 - DNA, 954 bp, Homo sapiens
  misc_feature: GYAE6OF02IQD19.14.70.G04.1.454.CMB.1.raw
tcagcgtctagtaccacgaccggtgctcgatttagtgtagtgtgaagggaaaggggagggcagttggtagatgcccctctgggagagatccccgaggggtgacagccatggaccctggaagggtcctgggctagggacagggaccagagccagtccgagggagaggacagagcaatggacgtggggtgtactgtaacagccctgccgtggcgaggacgggaccaggcgaccgtccgtccgagggacgcccagtcgaccgtgacgtaaggtccgggaccaggacggtcgaccccccgtaggtaacccgtaggaaacggccctaaagtccggaaccgacccgaaaggcccgaacggaccccgaaagggttcggggttacggttacggaccgtaccccgtaggacgggtacggacccggttcggggacccccttacggggtaccccggaagggccggtaaccggcccggtaccgttcccgggtcccccgttaggaccgttccggtaccggtcggttaccgggttggggttcccgtcgggaaccgttcgggttcccggacccggacccgttaccggggttcggacccgtcgtccgttcccggacccgtacccggttaacggttccggttccggacccggtaacccgggaacccggtaaacccggggtacccgggggtaaccccgttacccgggaacccccgggtacggggtaccccgttacccgggttaacggtaaccgggtttaacgggaaccgggtacccgtaacggtaaccccggttaaccgtacccggtaccggaacccgttcgggtaacccggaccgggtccgggttacggggtaccgggtaccgggtacccgggttaaccgggtaaccccgggtaccccgaaccccggtacccccgtaacccggttacccggttaccgtaccccgttacccggttcccgtttaaccccccgg

SEQ ID NO: 18775 - DNA, 921 bp, Homo sapiens
  misc_feature: GYAE6OF02IR23N.14.70.G04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (256)..(256): a, c, t, g, unknown or other
  misc_feature (256)..(256): n is a, c, g, or t
  modified_base (397)..(397): a, c, t, g, unknown or other
  misc_feature (397)..(397): n is a, c, g, or t
tcagcgtctagtaccacgaccggtgctcgatttagtgtagtgtgaagggaaaggggagggcagttggtagatgcccctctgggagagactcccccgagggggtgacagccatggaccctggaacgggcctgggactagggacagggaccagacgccagtccagggagaggacagganccaagtggacgtggggtntacgtgtaacncgccctgccgtgcggaggacggccgagggccaccgtccctccgagggacncccatcgcctagacgaacggtccggaccgaggacgggtccgacccccgtaggaacctacggaacggaccaagtcggaaccgaacccgtaaacgaccggacggtaccgtaaggttggggttcgtaggaacccggtaccccgngggtacgggacgtccgggtaccgggccccgttccggggaccccggaacgggtccacgggccggtcccggtccgggtccccctgggtccctggtccctacggttccgggtcggggttcccggtcggtaacccgggtcggttaccccggggttccggtaacccccgtggggtttccggtaccccgttccgggtcccgttacccggggaccccgttaaccccggttacggtttcgggtacccgaacccccggggttacccggaaccggggtaaaacccggggccccgggtaaacccggttaaccccgacccgggtacgggtacccgtcccggtaaccggggttacggtacccggaacgtacccggtaccgtacccggaccgttcccggacccggtcgggaccgtcccggggagggttcccgaacggggtccgggtcggaacccgggtccgacccgggaaccccggacccgttaacccccgaccccggtccttacccggacctttcccccggtacccttaccccccgg

SEQ ID NO: 18776 - DNA, 715 bp, Homo sapiens
  misc_feature: GYAE6OF02G6CK3.14.70.G04.1.454.CMB.1.raw
  modified_base (264)..(264): a, c, t, g, unknown or other
  misc_feature (264)..(264): n is a, c, g, or t
  modified_base (558)..(558): a, c, t, g, unknown or other
  misc_feature (558)..(558): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgcgtggcgagagggaccagggcaccgtcctccgagggacgcccatgctgcgaaggtcggcaggnggtcgccctagacctgaggccaagtgacgaccaagacgtaggaccgtagtgggttgtggacgaccctggaacggacggtcggcgggcctacggtcccgaggcgacgcgcgtcgccctgcgtgctcgtcgttggtcgcgcgtacgtcgtccgccgtagtcgccgtagccgtcggccgacgtaggtcgttacgcccgtaacggacggaaccgggaccgggaacccgtacgtacccggacgtaccggtcctaacgtcgggttacggaacgaccgaacgggtccctaccgggttaccnccgggacccggttacggacccgggtcgtacccgggtagggtaccgggggtccgtaacggggttcccgaacccggggtaccccggtaaaaccggtcccccgaaacccgggttaccgttaccccggtaacgttaccccggtttcccgttaccccccggg

SEQ ID NO: 18777 - DNA, 748 bp, Homo sapiens
  misc_feature: GYAE6OF02JRNQC.14.70.G04.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
tcagcgtctagtaccacgaccggtgctcgatttagtgtagtgtgaaggaaagggagggcgagttggtagagtgccctctgggagagatcccagggtgacagccatggaccctggaggctggctaggacagggacagagccagtccagggagnggacagagcaatggacngggtagtacngtaacagccctgctggcgagacggcagggcacggcctcgaggancccagcgactgacaggtccggcagaggtnccccngacagacgacagcgacgaccgaagacgagacgagtcggtacgtacgacgaccgtaggacgacgcgtacggccgtacggaccgacggacgcgcgacgtcgccgtacgcgtcgcgtcgtcgcggtcgtcggtacgtacgtccggtaccgccgtacgtccggtcgtacggtaccgtaccggccgtacccgtaacggttcgggttaccgtacccggacccggtaaccggtaacccgggaccggggtaacccgtacccggtacccgggttaccgggaccgttacccgggtaaccgggttacgggtacgggaaccgttcccggaaccggttaaccgtaccggacccgttacggtacccggaccgggtaccgggaacccggttccgggttacggggtaccccgggtaacggtaaccgggtaccggacccggtaacccggacccggtaccccgaaccgtacccggttaccgtacccggttaccggtacccgttacccgg

SEQ ID NO: 18778 - DNA, 746 bp, Homo sapiens
  misc_feature: GYAE6OF02GB5F6.14.70.G04.1.454.CMB.1.raw
  modified_base (186)..(186): a, c, t, g, unknown or other
  misc_feature (186)..(186): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacaggagccaatggactggggtntactgtaacagccctgctggcgaggacgggaccagggccaccgtcctccgagggacgcccatgctgaccaaggtccgggaccaggacggtcgcccccgtgaacccgtggaacggtccaagtacggacgaacccaagaccgaggaccctaaggtgggttaggtaggaacgtccccgtaggacggacggacgtcgggtcccgtcggtcccgacggtccgacggcgcgtcggaccccgtgccctcgcgtcgtcgtcgggtcgtcggacctaggtccggtacccggccgtacgtccggtccgtcggtcgtccgccgtacctaggttccggttacggccgtaccggaaccggtaaccgggaccggggtaacccgacggaccccgttggacccgaccgttcgggaacgtaacggtaaccgacggaccgactcccgaaggtcccacgggcgaccgtccgtagggtcgggcggttaccgggaccggtaccgaacccccggaacggacccccgtaacccgtcccgtaccggttacccctaccggttccccttaccgggttacccccccg

SEQ ID NO: 18779 - DNA, 703 bp, Homo sapiens
  misc_feature: GYAE6OF02F58F1.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaagggggagggcagttggtagatgcccctctgggagagatccccaggggtgacagccatggaccctggaagggcctgggctagggacagggaccaagagccagtccagggagaggacagagccaatggactggggtgtactgtaacagcctgctggcgagagggaccagggccaccgtcctccagggacncccatgctgactaaggtcggacagacggtcgcccctgaacctgaacggacaatcgacaccaagacaggcaaggtggtgtgtacgacccgtggacggtgcggtcggcccgtcggtacccgaggtccgacggccgccgttccggccccgtgtaccgtcgtcgtaggtcgttcggggtctgggtaccgtaggtccggtaccgcgtacggtcgtcgtcgcgtccgacccgtaccgtaggttcggtacgtaccgaacggtaccgaacgggcccgggaacccgacgtaccgtcgggacctcgtacggtagttacgtaacgaccgtacgcccggtactccgttaccgaccttcgggaccgaccggttacgtcggggttacggcccggtacgggtcccgaaaccgggtaccccaaccgggtccccaaccggttaccctcggtaacccttacccgtacccgtttaccccggg

SEQ ID NO: 18780 - DNA, 682 bp, Homo sapiens
  misc_feature: GYAE6OF02I5ZHT.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagacgccaatggactggggtgtactgtaacagccctgctggcgagaggcagggcaccgtcctcagggagcccatgctagcgtaacggtcgggaccaggacggtcgacccctagaaccgtgaacggcctaatcggaacaacccgaagaccgaggtccaaaggtgggttagtcgaacgtacccctgggacggacgacgtcggggccctcgggtcccgagggcacgccggtaccgtcggtccccgttaggccttggtactcggtcgttacgggtcgtggtcctaagtccggacgtcccgagttccggaccgtcgtcgtccgcgccgtaagtcggttcgccgtaccgacggtaaaccggccgggaaaccgtcggacccggtacgcgtaccgtcggtaggtcgacggcgtacgccgacaccggtcgccgtagggccgtaacggccgtagggtcgggcgtacggtcgaccggacccgtaacggtaccccaccgtccgtacgtaccgtccgttaccgttccccg

SEQ ID NO: 18781 - DNA, 787 bp, Homo sapiens
  misc_feature: GYAE6OF02G2QFV.14.70.G04.1.454.CMB.1.raw
  modified_base (187)..(187): a, c, t, g, unknown or other
  misc_feature (187)..(187): n is a, c, g, or t
  modified_base (755)..(755): a, c, t, g, unknown or other
  misc_feature (755)..(755): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctggctagggacagggaccagagccagtccgagggagaggacagacgccaatggacgtggggtntacgtgtaacaggccctgctggcgagaggaccgagggcaccgtcctaccgaggacgcccatcgactcgacaacgggtccgggaccgagggacggtccgcccgtaacgtaaccgtacgggaacgaccgtaaagtacggaaaccgaaccgaagaccggaacggtaccggtaagggttgggtagtaccggaccgtaccggtaggcggacgtcgggccggtccggtacggccgacggcgccggccgtcggccggccgtgtcgcgtcgtccgtgggtcgtcgtacggtctacggccgttaccgccgtacgggtcccgcgttaccggccgtacggaccccggttaacgtaggttcccgggtacaacccgggaaaccgggacccggaaaccccgggggtaccggtacccggtaaccgggttaccggacggttccccggtaacggtacgtacggggtacgaccgacccgggtcggaacctaccggccgtaccgtcgggaaccggcgtaccgggtcgggacggtaccgggacgtaacccgggaccctaaccgggaaccccgttaaccgaccgtaccnccggttccctacgtccccttccgtacccccgg

SEQ ID NO: 18782 - DNA, 819 bp, Homo sapiens
  misc_feature: GYAE6OF02JV5JO.14.70.G04.1.454.CMB.1.raw
tcagcgtctagtaccacgaccggtgctcgatttagtgtagtgtgaagggaaaggggagggcagttggtagatgcccctctgggagagactcccaggggtgacagccatggaccctggaagggcctgggctagggacagggaccagagccagtccgagggagacggacagagccaatggacgtgggtcgtactgtaacacgccctgctggcggagacgggaccagggccaccgtcctcgacgggacgccctatggcgtcgaccgaacggtccgggaccctaggtacggtccgacccccgtagaaccgtgaaccggccgaaagtacgacgaacccaaggaaccaggacccgtaaggttcgggttaggacgaaccggtaccccgtaggaacggtacggtcccgtcgggccccgttacgggaccccgaggccgtaggcccgtccgtcggtccccgtggccgtacggtcctcggtaccggttcggtacccgtacggacgtaccgttcgggacccgccgtaccggtcggtccgtccgtccgttacggacccgtaccgtaacggtccggttaacggcccgtaccggaaccggaaccgggtacccggaaccgtaccggtacccggtacgggtccgtaaccggtcggtaaacggttccggaaccgccgtaacggaccccggcgtacccgacggtccgtcggaccgggtacgggtacccgtcggggtacggaccgggtaccggaaccggtaacccgaacccggtacccggaaccccgttaaccccggtaccgttaaccggtcccgttacccgtccccgtttaaccccgg

SEQ ID NO: 18783 - DNA, 633 bp, Homo sapiens
  misc_feature: GYAE6OF02IA5XC.14.70.G04.1.454.CMB.1.raw
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcacccggtcctccgagggacgccccatcggctcggacaacggtcggggccaggaggtcgccccgtggaacctgaacggccaaagtgagacccaaagacaggccaagttggggttgtggagacccccgtgaggacgcgtgggccctcgggtcccaggcagcggcncggccctcgctcgctgcgtggtcncgggccatcggtcgccagtcggcctgctccgccgccgagttggtgccgaccggacgaacgggacccgggacccacggtacccgcgggacgccgtcgtaggtacgaggccacgggccacgtccgcggcctggccggagaccggttgggccggggaacgccgggtcgacccggtacccgaaccggacccctaacccaccgttcgacctacccgttccttacccccgg

SEQ ID NO: 18784 - DNA, 623 bp, Homo sapiens
  misc_feature: GYAE6OF02I9B39.14.70.G04.1.454.CMB.1.raw
  modified_base (400)..(400): a, c, t, g, unknown or other
  misc_feature (400)..(400): n is a, c, g, or t
tcagcgtctagtaccacgaccggtgctcgatttagtgtagtgtgaagggaaaggggagggcagttggtagatgcccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaaggtcggccagaggtgcccctgacctgaaggccaagtcgagacccaagaccaggaccaaggtgggttgtagacggaccctggacggagcgtgggcctaggtccaggcagcgtctacggccctgactgctgcgtggtcaggcctagtcggtcnccgtagtcggctcgctcgcgtaccgtagtcggttcgaccgacgacgtaaaccggcggggttaacccacggacccgttagggaccgtccctacggtacggttacggaacggtcgaacgaccgtagcccgagcccgtaggcggtacgccgtagggtcgggcgtacggtccgacggtacccgaacggtacccacccgtacgtaccgcgtaccgttccttaccccgg

SEQ ID NO: 18785 - DNA, 644 bp, Homo sapiens
  misc_feature: GYAE6OF02GSECO.14.70.G04.1.454.CMB.1.raw
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggagcccatgctgcaagtcgggccagaggtgcccctgaacctgaagccaatgacgaccaagacaggccgaagtggttgngacgtaccctggaggagcgtcgggccctggtccgngcagcgcgtcggccctgctgcgtcgcgtggtctggctagtcggtccgccgngttcggcctcgtcgtcgccgtacccgtagtcggttcgaccgaccgacggaaccggccgggaaccacggacccgtggacgtccgtacgtacggttcggaacgccgaacgcccggactacccgacggccgttacggccggtacggtccggtagggtccggggacgtacgggtaccgaaccggtaccccggaaccggaccccgaaccccgtaccgttaccggtacctacccggttccgttaacccccgg

SEQ ID NO: 18786 - DNA, 930 bp, Homo sapiens
  misc_feature: GYAE6OF02FOWSO.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggacccctgggaagggcctgggctagggacagggaccagagccagtccagggagaggacagagccaatggactggggtgtactgtaacagccctgctggcgagagggaccagggcaccgtcctccgagggacgcccgatggcctggacgaacggttccgggaccgaggacggtcgcccccgtaggaaacccctggaacggccgaaagtgaacggaacccccgaaagaaccgaacggaccctaaagggtcgggtttacggtcgggaacggacccccgttagggaacggggtaacggccgtaccgggggtaccccgtaccggggttaccccgaacgggccgaacggtacccggccgttaccggggaccccccggtttggaccccgtttggggccgttccgggtaccggtttccgggggttaccgttaccggggtacccgttaacggttcccggggtacccggtaccccgtaaggtttcccggggtccggttccgtcccggttcgggaccccggtaccccgtaaccggtttacgggtttaccggacccggtaacccggaaccggtaaaccgggacccgggggttaaaccccgaccgggtaaccccggttacgggaccgtaccgtaccggtaccggtttacggaacgggtacccgaaccggtaccggtaacccggtacccgacggtaccccggtacgggtacccgggacggtacccgggttacggggttaccggggaccggacgggttacccggaacccggtaaccccgaaccggtaaccccgaaccccgtaccggtaccgtaccggtaccttcccgttaccccgg

SEQ ID NO: 18787 - DNA, 826 bp, Homo sapiens
  misc_feature: GYAE6OF02GTAVY.14.70.G04.1.454.CMB.1.raw
  modified_base (237)..(237): a, c, t, g, unknown or other
  misc_feature (237)..(237): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtgcccctgaacctgaacggccaatcgagaccccaagacaggccaaggtggttagtgacgacccctgacggacgcgtgggtccctcgggtcccaaggtcgacgcgtctcgggccccctggccttcggctcggtcgtacgggttcgtggacccgtagttcgggttaccgccccggtaacgtcgggtacccgttcggtccggttcggacccggtcccctaaacggttccgggtttaccggacccgtaacccgggtaaccggaaaaaccggggtaccccgggggaacccccgtaacggggtaacccccgtaccggggtaaccggtaccccggtttaccggtaacggggttttaccgggaaaacgggtcccgaaaccgggtcccggtaaaccgttcccgaacgtaccccggttcgggcccggggtaacggtcccgggttacgggtacgggggtacccggtacggggttacccgaaccgggtacccccggtaaaccgggtaccccccgtaaaccccccggttaacccgttaccgggttacccctaaccccggtttcccgttaacccccggg

SEQ ID NO: 18788 - DNA, 764 bp, Homo sapiens
  misc_feature: GYAE6OF02IFGJZ.14.70.G04.1.454.CMB.1.raw
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggaggcagttggtagatgcccctctgggagagatccccgagggtgacagccatggaccctggaagggccgtggctagggacagggaccagagccagtccagggagaggacagacgaccaatggacgtggggtgtactgtaacagccctgcgtgcgagaggaccgaggcaccgtccgtcgagggacnccatgcctgacaaggtcggacctagacggtcgccctgaccgtagaacggaccaagtacgacgaaccaaagacgtaaggaccgtaagtcgggttacgtgaccgtaccccgtaggacggacgcgtacgggccctacggtcccaggccgaggtcccgctccggaccccgtggtcccgtgtccgtggtacgtcgggtcaccggggccttaaggtccgggttccgcccggtaggtccgtctaccggtcgtaccggtacccgaaccgtaacggttcgggtaaccgccgtaacccgggaagaaacccggggtaacccgggaaacccgtaaccggggtacccgtaccgggtaaccgtccggtacgtaaagggttacggaacgtcccggagacccgtaccgttaccgaacggtcccgcggtaccgaccggtacggtacggttaccgggggactaacggtccgaaacccggtaccccgtaacccggaccccaacggttacccgtacgtaccgttacccggtcccttaaccccgg

SEQ ID NO: 18789 - DNA, 759 bp, Homo sapiens
  misc_feature: GYAE6OF02HFOB0.14.70.G04.1.454.CMB.1.raw
  modified_base (246)..(246): a, c, t, g, unknown or other
  misc_feature (246)..(246): n is a, c, g, or t
tcagcgtctagtaccacgaccggtgctcgattttagtgtagtgtgaagggaaaggggagggcagttggtagatgcccctctgggagagatccccgaggggtgacagccatggaccctggaagggcctgggctagggacagggaccagagccagtccagggagaggacagagaccaatggacgtggggtgtactgtaacacgcctgctggcgagagggaccagggccaccgtcccgtccgagggacnccccgatcgctgacacggtccgggaccgaggacggtcgcccccgtagaaccgtacggaacggacccaaagtacggaacaacccgaaacggaaccgtaagggaccctaaaggggttcgggtttaggtacggacccggtaacccccgtgggtaaacggacggaccggtccgggccccggttcgggtaccccgagggccacggtcgccgtccgggtccccgtgcccgtcgccgttcggtcgttcgggtcgtcgccgtagttcggcccgcccgtaggttcccggacgtccgtacgtccggacctcccgtaacggttcgttaccgaccgtaccgaccggaaaccgggcccgggaacccgtaccggtacccggtacggccgtccgtacggtagggtacggaacgccgacggtacccgactccggcggtcccgccgggtcggaacgtcccggtgggaccggtcggtacgaccggacgacccgaaccggtccaacctcgtcgtacctcgttaccgtccccg

SEQ ID NO: 18790 - DNA, 891 bp, Homo sapiens
  misc_feature: GYAE6OF02HAWH7.14.70.G04.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacgtggggtgtactgtaaacngccctgctggcgagngggacagggcaccgtcctccgagggacncccatgctacgcgtaaacggtcgggaccaggtacgggtcgcccccgttagaaccgtacggaacggtaccgaaagttcggaaaccggaaccccgaaaggaaccgaaccgggaaccgtaaaacggggttcgggggttttaaggtacggtaaacccggtacccccggttagggaacggggtacggtacccggggttccggggtcccccggttacggggttacccccgaaaggggttccgaaccgggtcccggtccggtcccgggtcccccttggtccgtcggtccggtcgcgggttcgggtccgttcgggacgtcggttccgggtacccggtaccgtacggtccgggtccggtaccgtcccggtccggtaccccggtaacgtacgggtttccgggtccgtaaccgtaccccggggtaaaaccggtaaccccggggaacccggggtaaccccgaacccgggttccccggaggggtacctccccggttaaggtaaccgggttcgaaaccggtccgtaaccgtccgtaccgttaaccgccggggtccctaaggggtccgaccggttcgacgggtacggggactcgggtaccgaaccgggtaccccgaaccggtaccccgtacgtaccgtcccttaacgtcccgtacccgttaccccg

SEQ ID NO: 18791 - DNA, 809 bp, Homo sapiens
  misc_feature: GYAE6OF02FU5PS.14.70.G04.1.454.CMB.1.raw
  modified_base (290)..(290): a, c, t, g, unknown or other
  misc_feature (290)..(290): n is a, c, g, or t
tcagcgtctagtaccacgaccggtgctcgatttagtgtagtgtgaagggaaaggggagggcagttggtagatgcccctctgggagagactccccgaggggtgacagccatggaccctggaacgggcctgggctagggacagggaccagagccagtccgaggagaggacagagaccaagtggacgtgggtagtactagtacacgtcctggctcggacgtaggacgggacgacggccgtaccgtccgtccgagggacgacctatcgcctgaccacgtcggccaggacggtcncccgagtaaccgtaggaacgtacaacgtacggaaccaaccgaacggacaacggaccgtaaggtttacggggtcgtaacggtacggtaccccgtgggaacgggtagtcccggcgggtcccgtacgggtcccgacggacgtaccggccgtaccgtccggtcccgtcgtcccgtcggtaccgtcgttccgggttgaccgttccggacgtacggtttcccggaccgtacccggttacgtccgcggttccgtaccggtacgtacccggtacccgttaggttaccgggtaccggtacccgaacgggtaaaccggtaaacccggggaccggacccgtaaacccgggtcccggttaaccggaccgtcccggtttaacgaacgggttaccgaccggccgacggttcccgaacgttcccggaacgtacgcggtaccggtacggtcgtacgggacgggtccaacgggttacccgcgtaacccggaccgacccgtacccgtaacgtcccgtacgttaccgaccgttccccg

SEQ ID NO: 18792 - DNA, 717 bp, Homo sapiens
  misc_feature: GYAE6OF02ICSZ4.14.70.G04.1.454.CMB.1.raw
  modified_base (500)..(500): a, c, t, g, unknown or other
  misc_feature (500)..(500): n is a, c, g, or t
  modified_base (587)..(587): a, c, t, g, unknown or other
  misc_feature (587)..(587): n is a, c, g, or t
tcagcgtctagtaccacgaccggtgctcgatttagtgtagtgtgaagggaaagggagggcagttggtagatgcccctctgggagagatccccaggggtgacagccatggaccctggaagggcctggctagggacagggaccagagccagtccagggagaggacagagccaatggacgtggggtgtactgtaacagccctgcgtggacgagacgggaccgagggcacccgtcctccgagggacgccctatgcctgcgaaaggtccggaccaggaggttcgcccctagaaccgttggaacggacctaaagtcggaaacgaaccccgaaagaacgacggtaccaagggttcgggttagtacgaaccgtacccgtaggacgggacgtccggtcgggcccgtccgggtaccgaaggccgtacggccgtccgtccgggccccgtacgtcgtcgtccgtcggtccgttacgggtccgtacggtcccgtaggtccgtccggtacccgnggtccgtaccggtcgtcgtacggcccgtcccgtagttcggtacgcccgaaccggtacgaaccgggccggttaacccgacgttaccgnggtaccgtcctggtaacggtcggaacgcgtacggaccgtcgtaccgacggccgtacgcggaccgtcgtaggtccggcgtacggccaccgaacccgacgtaccgaccctcgtcgactcccgtacgtccccg

SEQ ID NO: 18793 - DNA, 993 bp, Homo sapiens
  misc_feature: GYAE6OF02GNP8P.14.70.G04.1.454.CMB.1.raw
tcagcgtctagtaccacgaccggtgctcgatttagtgtagtgtgaagggaaagggagggcagttggtagatgcccctctgggagagatccccagggtgacagccatggaccctggaagggcctgggctagggacagggaccagagccaagtccagggagaggacagagccaagtggacgtggggtgtacgtgtaacagccctgctggcgagacgggaccagggcaccgtcctaccgagggacgcccagtcggtcctcggaccgtaacggtccggggacccaagggtacgggttccgacccccgttaggtaaaccccgtaggaaaccggtacccgtaaagtacggaaaccgaaaccccgaaaacggtaaccgaaacgggtacccgtaaaagggttcggggttacggtacggaacccggtaacccccgttagggaacgggtacgtaccggtcggggaccccgttcgggtaccccgacgggacgtaccggaccgtccggttccgggaccccttacggtcccgtcggtccgtcggtacggtttcgggtccgttcggtaccgtaacggtttcccggaccgtccccgtaacggttccgggtccgttaccggacgttccgtaccccgggtacccgtttaaaggttccggggttaccgaaccccggttaacccggaacccgggtaaaccgggggacccccggggtaaacccgtaccggggttaacccccggtacgggtaaccgttaccccggtaacgggttaaccggtttaacgggaaaccgggttccgaaacccggtccgggttaaacctcccccgggacggtttaaccccggacgggtaacccggggttccggttaccggttcggggttacccgggggtaaccgttaccggggttaaccccggacccgggttaaccccggaaccccggtaaccccgaacccccggtttaacggtaccccggttaacgggttccccccttttaccgggttaacccccccg

SEQ ID NO: 18794 - DNA, 820 bp, Homo sapiens
  misc_feature: GYAE6OF02FQTQI.14.70.G04.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
tcagcgtctagtaccacgaccggtgctcgatttagtgtagtgtgaagggaaagggagggcagttggtagatgcccctctgggacgagactccccaggggtgacagccatggaccctgggaacgggcctgggctagggacagggaccagagccagtccagggagaggacagagccaagtggacgtggggtgtactgtaacngccctgctggcgagngggaccagggcaccgtccnccgaggacgccatgactgcaaggtcggccagacggtcgcccctgaacctggaacggccaagtcgacgaacccctaagacgacggaccgtaaggtgggttgtacggaacgtaccccgtaggacggtaagccggtacgggccccttcgggtaccccgagggtccgaacggtccggccggtacggtaccccgtggttccgcggtccgtcgggtccggttacggggtccgtacgggtcctaacggtccgggtacccgaccccgtgggtcccggtcgttacggcccgtaccggtacccgtaccccggttaagggttcggttacccggacccggtaacccgggaacccggaaaaccgggtcccccggggtaaccccgtacgggtaaacccccggttcgggaaacccggtccccggttaacggtaccgggttaacgggaccgtaaaccggtcggaaccgtacggtacccgtacggcccggtacggaccggtccggtacggtcgggtacgggaacgtacggacccggtacggaccccgttaaccggaccctaaccccgtaggtaccccgaccgttacccgtcccttacccccgg

SEQ ID NO: 18795 - DNA, 705 bp, Homo sapiens
  misc_feature: GYAE6OF02F6CV1.14.70.G04.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
  modified_base (615)..(615): a, c, t, g, unknown or other
  misc_feature (615)..(615): n is a, c, g, or t
  modified_base (689)..(689): a, c, t, g, unknown or other
  misc_feature (689)..(689): n is a, c, g, or t
tcagcgtctagtaccacgaccggtgctcgatttagtgtagtgtgaagggaaaggggagggcagttggtagatcgcccctcgtgggagagactccccgaggggtcgacagccatggaccctggaagggcctgggctagggacagggaccagacgccagtccagggacgaggacagacgccaatggacgtggggtntacgtcgtaacngccctgcgtggcgaggacggccgagggccaccgtccncgaggggaccncccgagtcgctacgccgaaggtccgggaccaggtaacggttccacccgtacgtaaccgtagaacgggccaagtcgaaccggacccaaaggaccgacggtacccgtaaggggttcggtagtccgggaacgtcccccgngggaaaccggttggaccggttccgggccccgtaggacccgtcgggacacggtaccgccgtttccggccctggtaccngggtcctggtccggtaggtccgaacgcctagttaccggcccacgagtccggcctcgacgcgccacggtcgtacggtacgacccgtagaaccggacggtacccggaccaccggcgacggtcgccgtagtcgacggaagtccgacgccncggtacaccggtcgaacggccgtacgcgggtgtaccgggcaacggtccgacgtacgacccgtaccacgcctacncgtaccttacgtcccg

SEQ ID NO: 18796 - DNA, 929 bp, Homo sapiens
  misc_feature: GYAE6OF02GZTR8.14.70.G04.1.454.CMB.1.raw
  modified_base (249)..(249): a, c, t, g, unknown or other
  misc_feature (249)..(249): n is a, c, g, or t
tcagcgtctagtaccacgaccggtgctcgatttagtgtagtgtgaagggaaaggggagggcagttggtagatgcccctctgggagagactccccgaggggtgacagccatggaccctgggaagggcctgggctagggacgagggaccagagccagtccagggagaggacagagccaagtggactggggtgtactgtaaccagccctgctggacgagaggaccagggccaccgtctcgagggacgcccancgctgacaacgtcggaccaggacggtcaccccgtagaaccgtacgaacggccaagttacggaacgaacccaaacggacgaacggaccgaaaggttacgggttagttacggaacggtacccccgtagggtaacgggtacggaccggttacgggggtccccgtccggggttacccgaacggggtaccgaacgggccggtaacccggttaccgggtaccccccgttccggtacccgtcggtacccgttacggggtaccggttttaccggggttccggtacgggtcccgtaaacggttcccgggtaacccgggtaccccgttacgggttaaccgggtccggtttccgtcccggtttaccgacccccggtacccggtaaacggtttacggggttaccgtacccggtaaacccggaacccggggttaaaaccgggaacccggggtaaaccccgttaaccggaacccgggtaccggtaaccgtacccgttaccggtaacgggttaaccgggtaaaccgcgtaaaccggtacccgtaacgttacccgaaccggttacccgtcgggtaaccggacccgggtaccgtggggttacccgggaacggttaaccgggcccggaacttaacccccgggacgaacccccgttaaccgaccgttacccggtaccttaccgtccctttaacccccgg

SEQ ID NO: 18797 - DNA, 384 bp, Homo sapiens
  misc_feature: GYAE6OF02F0OTQ.14.70.G04.1.454.CMB.1.raw
  modified_base (190)..(190): a, c, t, g, unknown or other
  misc_feature (190)..(190): n is a, c, g, or t
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (377)..(384): a, c, t, g, unknown or other
  misc_feature (377)..(384): n is a, c, g, or t
tcagcgtctagtaccacgaccggtgctcgatttagtgtagtgtgaagggaaaggggagggcgagttggtagatgcccctctgggagagatccccaggggtgacagccatggaccctggaagggcctgggctaggacagggaccagagaccagtccagggagaggacagagccaatggactggggtgtacngtaacagccctgcgtggcgagagggacctagggcaccgtcctccagggancccgatgctgcaagtcgggccaggaggtncccctgaacctgaaggccaatgacgaccaagcacggcaagtggtntganccctgagancgtgggaccnggtcccaggccagccgctcgcctgctaggctgctggtacnnnnnnnn

SEQ ID NO: 18798 - DNA, 832 bp, Homo sapiens
  misc_feature: GYAE6OF02FN5NH.14.70.G04.1.454.CMB.1.raw
tcagcgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactgggtgtactgtaacagccctgctggcgagagggaccaggcaccgtcctcgagggacgccatgctgcaagtcggccagacggtcgcccctgaacctgaacggccaaatgacaccgaagacaggccaagtgggttgtagacgacccctggacggagcgtgggacccttgggaccctagggccacggtccgacgtcggcccctgaccgtgctcggtccgtacgggtcttacggccgtagtcggttccgacccgtaacgtttcgggacccgttcggtaccgtacggtaccccgtaaccccgtaaagggttacccgggtttacggaccccgtaaaccgggtacccgaaaaacggggtacccgggggtaaacccctaacgggttaacccccggtaacggggaacccgttacccgtttaaccgggtaacggttttacggggaaacccgaccggtaaaccgggaccccggttacgtaaaccccgtacggtaaacccggttagggaacccgggttacgggtaccccgggttacggggttaccgggggtaacggaccggggtttaacccgaacccggtaaccccgttaaaacggggacccccctaaaccccggttaaccgttaccgggtaaccccgacccgttttaccccggttacccccggg

SEQ ID NO: 18799 - DNA, 895 bp, Homo sapiens
  misc_feature: GYAE6OF02JEADI.14.70.G04.1.454.CMB.1.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
tcagcgtctagtaccacgaccggtgctcgatttagtgtagtgtgaagggaaaggggagggcagttggtagatcgccccctcgtgggagagactccccgaggggtgacagccagtcggacccgtgggaagggccgtgggcgtagggacgagggaccagagccgagtccgagggagaggacagagaccaagtggngtgggtgtacgtgtaacncgcctgccgtggacgaggacgggaccgacggccgtaccgtccctaccggagggaccgacccgatcgccgtagaccgtacggtccgggacccgaaggtaccggtccgtacccccgaaggtaacccgtacggaaccggaccgtaaacggttaccgaaaccgtaaaccccgaaggaaccggaacggtaacccggtaagggtttcgggtttaaggtacccggaaccggtaccccgttagggaaccggtaccggtcccggtaccgggtaccccgttaccgggaccccggtaggacccgtacgggcccggttcccgtccgggtacccctcggttcccgtcgtcgttccggtacggtcgggttccgtcggcccgtacggtcggtacccgaccggttcgtccggtccgtcgacgtccggtccgtaccgtacgtcggtaccgtaccgaccggaaaccggtacccggaccggaacccggtaccggtaccggtaccgacccgtaccgtaccggttaacgttaccggtaaccggttaccgaccggtaaccgtaccgttccggtacccggtcggtaccgggaccggtccgtcgggtaaccggccgggtccggaccggtaccggaacccggacccggtaacccggaacccgtaccggtaccgttacccggtaaccgttcccgttacccggttccccgg

SEQ ID NO: 18800 - DNA, 747 bp, Homo sapiens
  misc_feature: GYAE6OF02IT8AC.14.70.G04.1.454.CMB.1.raw
tcagcgtctagtaccacgaccggtgctcgattttagtgtagtgtgaagggaaaggggagggcagttggtagatgccccctctgggagagatccccaggggtgacagaccatggaccctggaagggcctgggctagggacagggaccagacgccagtccagggagaggacagagccaagtcggacgtgggggttagtaccgttgtaaccgagcccttggaccttgggcgaacggagggaccctaaggggccctaccgtcccgttaccgagggacgcccctaatcggcctgaccgaaggttccgggaccctaaggaggtccgtcccccgagtaaccgtacgaacgactagtacgaaccgaaccgaacgacgacgacgtaaggtaggtggtacgcgtaccgtagacggacgcgtcggtccgtcggaccgacggcgacgccgtccgcgccgtcgtcgtcgtcgtcgtcgtcggtcgtcggtacgtacgtcgtaccgccgtacgtccgcgtcgcgtacgaccgtacgtacgttcgtacgaccgaaccggaccggtaacgggccggaaccgtaccggtaccgtcggaccgtaccgtacgtacgtacggacgtacggaccgaccggtaccgtaccgtaccggacggtacggaccgtacgggtccgtcgggtacgggtacggtaccgaccggaaccgaacccggaaccgaccccgtaaccgtacccgtacgtacccgttccgtaccccgtacccg

SEQ ID NO: 18801 - DNA, 746 bp, Homo sapiens
  misc_feature: GYAE6OF02H8FG7.14.70.G04.1.454.CMB.1.raw
  modified_base (189)..(189): a, c, t, g, unknown or other
  misc_feature (189)..(189): n is a, c, g, or t
tcagcgtctagtaccacgaccggtgctcgatttagtgtagtgtgaagggaaaggggagggcagttggtagatgcccctctgggagagactccccgaggggtgacagccatggaccctggaagggcctgggctagggacagggccagagccagtccgagggagaggacagagccaagtggactgggggtntacgtagtacacgccctgctggcgaggacggaccgagggccacccgtcctccgaagggacgcccgtagtcgccgtgacgaagggtccgggccaagggacggtccgccccgtaggaaccgtacggaacggtaccaagtaggaaccgaacccgaaaggaacgaacggaccgtaagggttgggttagtcggaccgaccccggtggacggaggtccgtccgggtcccgtcggtacccggaggccgtacggcgccgtcggccctgccgtgcgtcggcgtggtccgtggccgtagtcggcccgtccgtacgtccggtccgtgtccgtcgaccgtaccgtagttcggtcgaccgtaccggaggaaccgggacccggtaacccgtaccggtaccggtgtaccgtccgtacggtacggttaggaacgcgtaaccgccgtacgtccggacgtccggacggacggtccggacggttcggggtaaccggcgtaacgggccgtaacccggacccgtaacccgaccccgaacccggtccgtaacccgtcgtaccccgttccgttacccccg

SEQ ID NO: 18802 - DNA, 630 bp, Homo sapiens
  misc_feature: GYAE6OF02HGHJU.14.70.G04.1.454.CMB.1.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
  modified_base (530)..(530): a, c, t, g, unknown or other
  misc_feature (530)..(530): n is a, c, g, or t
  modified_base (577)..(577): a, c, t, g, unknown or other
  misc_feature (577)..(577): n is a, c, g, or t
  modified_base (614)..(614): a, c, t, g, unknown or other
  misc_feature (614)..(614): n is a, c, g, or t
  modified_base (621)..(621): a, c, t, g, unknown or other
  misc_feature (621)..(621): n is a, c, g, or t
tcagcgtctagtaccacgaccggtgctcgatttagtgtagtgtgaagggaaggggagggcagttggtagatgcccctctgggagagatccccgagggtgacagccagtggaccctgggaagggcctgggccgtagggacagggaccagacgccagtccaggggaagaggacgagaggccaaagttggaccgtgggggtataccgtaggtaacacggccctggctggnggagacgggaccgagggtccacggtcccncgagggacgccctagtcgctaggactaaccggnggaccaggacggtcgcccgtagacccgtaggacgactaagcggaacaccgagacaggtccgaagtgggtcaggactacccgtgggagtanccgttcggcccttaggaccaggacgacgcgttccgggtcctcggtatnccggttanccgggtagttcgcgtaacgcgtgcccgactttgcggtaccngccgtacgccgaccgagttgcgacgtacgacgaacggcggaccacgccgtgacncgtacacgtcgaacgacgtacgacgtacgtacgacgccgtacgacgngtacgcggtcgagcggcacgaccgtacgccacgacgncccgtcncggtacccg

SEQ ID NO: 18803 - DNA, 664 bp, Homo sapiens
  misc_feature: GYAE6OF02JPHQG.14.70.G04.1.454.CMB.1.raw
  modified_base (266)..(266): a, c, t, g, unknown or other
  misc_feature (266)..(266): n is a, c, g, or t
  modified_base (568)..(568): a, c, t, g, unknown or other
  misc_feature (568)..(568): n is a, c, g, or t
tcagcgtctagtaccacgaccggtgctcgatttagtgtagtgtgaagggaaagggagggcagttggtagatgcccctctgggagagactccccgaggggtgacagccatgaccctgggaaggctggcgtagggacacgggaccagagccgacgtccgagggagacggacagacgacaagtaggacgtggggtgtacgtagtaacgacgccgtcgcgtggccgaagggcggaacctagggcctaccgtccgtacgagggacaccctntcgctgactaggccggaccaggtaggtccgccgtgaccgtgacgactacaggacaaccagacgacgcgtaggtaggtagacgtaccgacgtgggacgtagcgtccggggaccgtccggtcgtacgcgcggtccgtccgtcgcccgtagcgtcgtcgtcggtaacgggttggtaccggtcgccgtagtcccggggtactccggtcgtacgccggtcgccgtacggacctccggtacgtcggacgccgacggtaccgacggtccggacctaccggtacgtccgacgtccgtactcggtgaccgngacgtaccgacgccgtcgcgtacgcgtacgcggagccggacgtcgcgaccggaccgtacgaccccgctacggtaccgtcgttacctacccgtcccg

SEQ ID NO: 18804 - DNA, 789 bp, Homo sapiens
  misc_feature: GYAE6OF02HKSKI.14.70.G04.1.454.CMB.1.raw
  modified_base (71)..(71): a, c, t, g, unknown or other
  misc_feature (71)..(71): n is a, c, g, or t
  modified_base (288)..(288): a, c, t, g, unknown or other
  misc_feature (288)..(288): n is a, c, g, or t
  modified_base (541)..(541): a, c, t, g, unknown or other
  misc_feature (541)..(541): n is a, c, g, or t
tcagcgtctagtaccacgaccggtgctcgatttagtgtagtgtgaagggaaaggggagggcagttggtagntgcccctgtgggagagactccccgagggtgacagccagtcggacccgtggacggcctgggctagggacgaggaccagacgccagtccgagggagacggacacgagccaagttcgggacgtggggtcgtacgtacgaaccgagtccccgtgccgtgggacggaggacgggccgaagggcctcccggtccgtacccggagggacctccccgagtcgganaggaaccgaacggcccgggacctaagggaggttacccgccccggtacgaaaccgtcggaaaccgaccgaaacgacgaacgacccgaaaagacggacggtaaccgtaaacggtgggttcgtacggaaccgacccggttaggaaacggcggtcgtcgggcccgtaccggtaccggcggaacgcggaccgccggtcggtcccgtagtccgttcgaccgtggaccgttcggttcgcgtcgcgtttcgccgtacccgngtccgtcgtacggtcgtcgtcccgtaacgtcggtaacggttcgaccggtccgaaccgggaaccggccggaaccggtacgaccggaccggtaacgtccgaacggtggttaaccggagcccggacgtacgtaccgcgaaccgtcgaacgggtcgaacggtccgttacgggaccggacggccggtaacgcccggaaccggaacgcccccgaccgttaccgacccggtaccgtacccgtcgttaacccccgg

SEQ ID NO: 18805 - DNA, 591 bp, Homo sapiens
  misc_feature: GYAE6OF01BBSWN.11.79.H02.1.454.CMB.1.raw
  modified_base (446)..(446): a, c, t, g, unknown or other
  misc_feature (446)..(446): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (585)..(591): a, c, t, g, unknown or other
  misc_feature (585)..(591): n is a, c, g, or t
tcagcgagagataccacgaccggtgctcgatttagtgtcacacgaagggaaagggtccctgagactctcctgtgcagcctctggattcacttttagcaactatgtcatgcactgggtccgccaggctcctggaaaggggctggagtgggtctcgtctattgctggcaatgataataccgtaaactacgcagactccgtgaacgggccgtcaccatctcgaggacaattccatgaacactactttatcttacaattagaactaccctagacggccgacgacacggccgtatattactgtgacgaaggactacggatcgcgtagtacttctttgaccacgtcgggaccacgggaaccctggtaccaccgtctccctcacgccctccaaccgacgggtcccacgtccggtcccttcccccgtggccctacccctcctaccgaacgtacnccacccgttcggtcgggggaccacgtacggacccggcccgtcgggcctcggacccgtggtacgaacggtaccgttacgttccgtactcctccgtcgctggacgcgggcgtggacgtaggccgtacgngtancgncngcnnnnnnn

SEQ ID NO: 18806 - DNA, 502 bp, Homo sapiens
  misc_feature: GYAE6OF02IBSCS.11.79.H02.1.454.CMB.1.raw
  modified_base (410)..(410): a, c, t, g, unknown or other
  misc_feature (410)..(410): n is a, c, g, or t
  modified_base (493)..(502): a, c, t, g, unknown or other
  misc_feature (493)..(502): n is a, c, g, or t
tcagcgagagataccacgaccggtgctcgatttagtgtcacacgaagggaaagggtccctgagactctcctgtgcagcctctggattcacttttagcaactatgtcatgcactgggtccgccaggctcctggaaaggggctggagtgggtctcgtctattgctggcaatgataataccgtaaactacgcagactccgtgaagggccggttcaccatctccagggacaattccatgaacacactttatcttcaattgaacaccctgagggccgacgacacggccgtatattatgtgcgaaggctacgatctcgagtacttctttgccactggggccagggaaccctggtcaccgtctcctcagcctccaccaaggcccatcgtcttccccctggccacccctcctccaagngcacctcgtggggcacagcgcctggctgctgtcaggactactccgtatctctccgcttgagcgggctggcaaggcgcatacgnnnnnnnnnn

SEQ ID NO: 18807 - DNA, 644 bp, Homo sapiens
  misc_feature: GYAE6OF02H7C9I.11.79.H02.1.454.CMB.1.raw
  modified_base (623)..(623): a, c, t, g, unknown or other
  misc_feature (623)..(623): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (642)..(644): a, c, t, g, unknown or other
  misc_feature (642)..(644): n is a, c, g, or t
tcagcgagagataccacgaccggtgctcgatttagtgtcacacgaagggaaagggtccctgagactctcctgtgcagcctctggattcactttttagcaactatgtcatgcactgggtccgccaggctcctggaaaggggctggagtgggtctcgtctattgctggcaatgataataaccgtaaactacgcagactccgtggaagggccggttcaccatctccgagggacaattccatgaacactactttatcttacaattgaacctaccctaggacggggacccgacgaacaccgggccgtattattactgtgacgaaggactaacgattcgtacgagttactttctttcgaccctacgtcgggggacccgaacgggtaaccccgtggtacctaccgtacctccctacacgccttcccgaacccgaacgggaccccacgtccgttacccttcccccgtcggccctaacccctccctacccgaacgacgaccctacccgtccggtcgggggactacccgacggtccggcccgtacggggccttcggccgtgggtaccgacggtaccttaccgttccgtacttcctccgtcgcgtggcgtcgggcgtcgggcgacggcgtacgngtagcagtnacgncnngcnnn

SEQ ID NO: 18808 - DNA, 664 bp, Homo sapiens
  misc_feature: GYAE6OF02GGOEY.11.79.H02.1.454.CMB.1.raw
  modified_base (120)..(120): a, c, t, g, unknown or other
  misc_feature (120)..(120): n is a, c, g, or t
  modified_base (219)..(219): a, c, t, g, unknown or other
  misc_feature (219)..(219): n is a, c, g, or t
  modified_base (648)..(649): a, c, t, g, unknown or other
  misc_feature (648)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (659)..(660): a, c, t, g, unknown or other
  misc_feature (659)..(660): n is a, c, g, or t
  modified_base (662)..(664): a, c, t, g, unknown or other
  misc_feature (662)..(664): n is a, c, g, or t
tcagcgagagataccacgaccggtgctcgatttagtgtcacacgaagggaaagggtccctgagactctcctgtgcagcctctggattcacttttagcaactatgtcatgcactgggtccnccgaggctccgtggaaaggggctggagtgggtctcgtctattcgctggcaatgataataccgtaaactacgcagactcgtgaaggtccgttcaccatcncgaggacatcatgaacactacttactcttacaattcgaaccaccctgacggaccgacgaacacggaccgtatacttacgtgtcgacggtaacggactacgacttcgtacgtacgttaccttcttttacgaccgtaccggtcggggacccgaacgggtaaccccgtcggtaccgtaccgtcctccctacgaccgccctacccgaacccggaacgggccctacgtccgttccccttcccgtcggccctaccccgtccctaccggaaacgtcgtacccgacccgttcggggtccggggccaacgggaccggccccggtacccgggtcgggtcccggtcgcccgggttagaccgaaaccggtccttaccgttcgttacttccgtcctccgcgtggacgtccggcgtacgggacacgggccgacggtatacggnngngngcngcnncnnn

SEQ ID NO: 18809 - DNA, 502 bp, Homo sapiens
  misc_feature: GYAE6OF01BVBTI.4.10.A10.1.454.CMB.1.raw
  modified_base (267)..(267): a, c, t, g, unknown or other
  misc_feature (267)..(267): n is a, c, g, or t
  modified_base (375)..(375): a, c, t, g, unknown or other
  misc_feature (375)..(375): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagcaaaaaccagggaaancccctaagctcctgatctatggtgcatccactttgcaaagtgggtcccatcaaggttcagcggcagtggatctgggacagatttcactctcaccatcagcagccctanagcctgaagtattttgctaacttattactgtacaacagtactttaaataattacgcgtacttcacgtttcggcggtagggacctaagggtggagatacaaacgactgtggctaggaccacatcgtcg

SEQ ID NO: 18810 - DNA, 518 bp, Homo sapiens
  misc_feature: GYAE6OF01ARPH2.4.10.A10.1.454.CMB.1.raw
  modified_base (270)..(270): a, c, t, g, unknown or other
  misc_feature (270)..(270): n is a, c, g, or t
  modified_base (512)..(512): a, c, t, g, unknown or other
  misc_feature (512)..(512): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatggtgccatccagttgacccagtctccatcctccctgtctgcatctataggagacagagtcaccatcacttgccgggccagtcagggcattttcagttatttagcctggtatcagcaaaaaccagggaaacncccctaagctcctgatctatggtgcatccactttgcaaagtgggtcccatcaaggttcagcggcagtggatcgtgggacagtatttcacttctcaccatcagcagccctacagcctagaacgtattttgactaaactttattactgtaccaactagtactttaaataactttacgcgtctctacgtttcggcggaggaccaagggtcggagtatacgaaacgtaacgtgtggctgaccactntcgtcg

SEQ ID NO: 18811 - DNA, 564 bp, Homo sapiens
  misc_feature: GYAE6OF01ATAAZ.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctcctgtctgcatctataggagacagagtcaccatcacttgccgggcagtcagggcattttcagttatttagcctggtatcaagacaaaaaccgagggaaacgcccctaagctcctgatctatggtgcatcctactttgacgtaaaggtcggggtcccatcgaaggttcagcggcagtggatcgtgggacagtatttcactctcaccatccagccacgaccctacgacgtcctaggaacgtattttgactaaactttatactagtaccaactagtactttaataacttaccgcgtactacgtacgtttcgggacggtacgggtaaccgaagggtaggaacgtagtaccgaaaacggtacgttaggtaggtaccttaggaccctacctagtcgttacg

SEQ ID NO: 18812 - DNA, 576 bp, Homo sapiens
  misc_feature: GYAE6OF01BCD8I.4.10.A10.1.454.CMB.1.raw
  modified_base (390)..(390): a, c, t, g, unknown or other
  misc_feature (390)..(390): n is a, c, g, or t
  modified_base (566)..(566): a, c, t, g, unknown or other
  misc_feature (566)..(566): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcaggctatttcagttattagctggtatcagacaaaaccgagggaacgacccctaagcctcctgactctagtggtgcactcctatttgacgtaaggtcgggtaccagtcgaaggttcaggcggcaggtggatcgtagggactagtatttcactctacaccatcagcagccctanacgtctagaagttcttttacgacttaactttattacttagtactaacgagttaactttaaagtaacgtttaccgactaccttaccgtacgtttaccgggacgggtaacgggaaccgtaagggtcggaacgtaactaacggaaaacgtaccgttggtacgtacgtcgacctaccgtnttcccgttag

SEQ ID NO: 18813 - DNA, 729 bp, Homo sapiens
  misc_feature: GYAE6OF01B7QXW.4.10.A10.1.454.CMB.1.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttggccggccagtcgagggtctattttcagttattagctggtatcagacaaaacaggaacnccctaagctctgatctatggtnctatcctactttgactaaaggtcgggtacccagtaccgtaaaggttcgaaggtccgggactagggtacggaattcggttagggggaacctaaggttaacttttccgaaccgtttcctacctaacccgtaattaccgaacggtacctaacggtaccccttaaacgaccggtacccttaagggtaaacgtttaacgttttttacggaaccctttaaacttttaacgtttaaccgttacgttaacctaaaaccgttagttaaacccttttaaaacgtttaaacgtttacccggaccgttaccgtttaaccgttaacccggttttccggggaaccgggtaacggggtaaacccgtaaaggggttaccgggaagtaacgtaaccgtaaaacggtaacgttacgggtacggtaccgttacgaccctaacccgtagttccgttacgg

SEQ ID NO: 18814 - DNA, 653 bp, Homo sapiens
  misc_feature: GYAE6OF01EKPY0.4.10.A10.1.454.CMB.1.raw
  modified_base (272)..(272): a, c, t, g, unknown or other
  misc_feature (272)..(272): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagccttggtatcagacaaaaaccgagggaaacncccctaagcctcctgactctatggtgctatcctatttgactaaaggtcggggtacccagtcgaaaggttcaggcggcaggtggatcgtagggacagtatttcactctacacatcagccagcctaacacgcctagaacgttattttcgacttaaacgtttacttacgtacgtaacctaaacgtagttaacctttaaacttaaacgtttaacccggtacgttaccctttaaccgttaacccggtttttcccgggggaacggggttaaaccgggggtaaacccgtaaagggggttacgggaaacgttaacgttaaacccggtaaaaaccggtacgttcgggtaaccgggtacttaccggacctaacccgttattccgttaccgg

SEQ ID NO: 18815 - DNA, 544 bp, Homo sapiens
  misc_feature: GYAE6OF01DLXFS.4.10.A10.1.454.CMB.1.raw
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccagggaaancccctaagctcctgatctatggtncatccatttgacaagtgggtcccagtcaaggttcagcggcaggtggatcgtgggacagtatttcactctcaccatcagcagccctanacgcctagaagtattttcgactaactttattactnttacaactagtacttaaataacttacgcgtacttactacgtttgggacgggtacgggacccgtaagggtacggaagtaagtacgaaaacggacgttggtacggtactacgaccaacctgttccgtacg

SEQ ID NO: 18816 - DNA, 561 bp, Homo sapiens
  misc_feature: GYAE6OF01DN700.4.10.A10.1.454.CMB.1.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (553)..(553): a, c, t, g, unknown or other
  misc_feature (553)..(553): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagccttggtatcagacaaaaaccngggaaancccctaagctcctgatctatggtgcatccactttgacgtaaaggtggggtacccagtcgtaaggttcaggcgcaggtggatcgtgggacaggtatttcacttctcacatcagcacgtccctacgacgtcctagaagtattttacgacttaactttattactacgtacaacgtaagtactttaaattaacgttacgacgtcttacgaccgtttcgggaccggtaagggaccgtaaaggggtcggaagattaacgaaacgtacgtggtacggctacgaccacctntcgttacg

SEQ ID NO: 18817 - DNA, 545 bp, Homo sapiens
  misc_feature: GYAE6OF01CKPKX.4.10.A10.1.454.CMB.1.raw
  modified_base (266)..(266): a, c, t, g, unknown or other
  misc_feature (266)..(266): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcagggcattttcagttatttagcctggtatcagacaaaaccagggaaancccctaagctcctgatctatggtgcatccactttgcaaagtggggtacccatcaaggttcaagcggcagtggatcgtgggacagtatttcacttctacaccatcagcacgccctacacgcctagaagtattttagacctaactttacttaacttgtacaactagtactttaataacttacgccgtcttactaccgtttacgggacggtacgggtaccgaagggtcggaagtactacgtaaaacggacttggtcggtactacgaccaccgattccgtacg

SEQ ID NO: 18818 - DNA, 537 bp, Homo sapiens
  misc_feature: GYAE6OF01BUULM.4.10.A10.1.454.CMB.1.raw
  modified_base (190)..(190): a, c, t, g, unknown or other
  misc_feature (190)..(190): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcacatcacttgccgggcagtcagggctatttcagttattagcctggtatcagacaaaacgaggaacncccctaagctcctgatctatggtncatccatttgactaaagtcgggtcccatcgaaggtcagcgcagtgatcgtgggacagtattcactcncacatcagcagcctacacgtcctagtaacgtattttgacttaacttattactagtacaactgtaactttaatacttaccgcgtactacgtacgtttcggacgggtaacgggtaccgaagggtcggaagtacgtaacgaaacgacgttggtacgggtcctacggaccaacctgttccgttacg

SEQ ID NO: 18819 - DNA, 551 bp, Homo sapiens
  misc_feature: GYAE6OF01CVZ0W.4.10.A10.1.454.CMB.1.raw
  modified_base (266)..(266): a, c, t, g, unknown or other
  misc_feature (266)..(266): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctatttcagttattagcctggtatcagacaaaacaggaaacnccctaagctcctgatctatggtgctatcctactttgactaaaggtcggggtcccagtacaaggttcagcggcaggtgatcgtgggacagtatttcactctcaccatcagcacgcctacagcctagaagtattttcgacttaactttattaactgtactaactagtactttaaataacttaccgacgtacttaccgtacgtttcgggacggtaacgggaccgtaagggtacggaagtaattacgaaaacgtacgtggtacggcttagacctacctattccgttacg

SEQ ID NO: 18820 - DNA, 553 bp, Homo sapiens
  misc_feature: GYAE6OF01BHTAI.4.10.A10.1.454.CMB.1.raw
  modified_base (291)..(291): a, c, t, g, unknown or other
  misc_feature (291)..(291): n is a, c, g, or t
  modified_base (399)..(399): a, c, t, g, unknown or other
  misc_feature (399)..(399): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaccagggaaagcccctaagctcctgatctatggtncatccatttgcaaaggtcggggtcccatcaaggttcagcggcagtggatcgtggggacaggtatttccactctacaccatcagccagccctaacgcgcctagtaagtnttttcgacctaactttattactcgtacaactagtactttaaataacttacgcgtctactacgtttcgggacggacgggtaccaaggggtaggacgtataaccgaaacggtaaccgttggtacgggtaccttaggaccctacctattccgttacg

SEQ ID NO: 18821 - DNA, 519 bp, Homo sapiens
  misc_feature: GYAE6OF01CASGI.4.10.A10.1.454.CMB.1.raw
  modified_base (270)..(270): a, c, t, g, unknown or other
  misc_feature (270)..(270): n is a, c, g, or t
  modified_base (399)..(399): a, c, t, g, unknown or other
  misc_feature (399)..(399): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaacncccctaagctcctgatctatggtgcatcctactttgacaaagtcgggtacccagtcaaggttcagcggcagtggatcgtgggactagtatttcactctcacatcagcacgcctacacgcctagaagttnttttacgactaactttattactagtacaactagtacttaataacttacgctctctacgtttcgggacggaggacctaagggtggagatacgaaacgacgtggtagctgacacctgtctcg

SEQ ID NO: 18822 - DNA, 521 bp, Homo sapiens
  misc_feature: GYAE6OF01B8MRA.4.10.A10.1.454.CMB.1.raw
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (514)..(514): a, c, t, g, unknown or other
  misc_feature (514)..(514): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaacgagggaaacgcccctaagctcctgatctatggtgcactcctactttgacgtaaaggtcggggtacccataccgaaggttcaggcggcaggtggatcgtgggacaggtatttcactctcacntcagcagccctanagcctagaagtatttgactaactttatactgtacaactagtacttaataattacgcgtactactacgtttcggacggtaggaccaagggtggagtatacgaaagacgtgaggctgacacngtcttcg

SEQ ID NO: 18823 - DNA, 517 bp, Homo sapiens
  misc_feature: GYAE6OF01DKKVH.4.10.A10.1.454.CMB.1.raw
  modified_base (269)..(269): a, c, t, g, unknown or other
  misc_feature (269)..(269): n is a, c, g, or t
  modified_base (392)..(392): a, c, t, g, unknown or other
  misc_feature (392)..(392): n is a, c, g, or t
  modified_base (511)..(511): a, c, t, g, unknown or other
  misc_feature (511)..(511): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaancccctaagctcctgatctatggtgcatccactttgacaaagtgggtcccatcaaggttcagcggcagtggatcgtgggacagtatttcactctacacatcagcagccctacagtcctgaagtnttttagactaactttattactgtacaactagtacttaataacttacgctacttacctacgtttcgggacggtaggaccgtaagggtggaagtatacgaaacgactgtggctagacactntcgtcg

SEQ ID NO: 18824 - DNA, 580 bp, Homo sapiens
  misc_feature: GYAE6OF01DRFM3.4.10.A10.1.454.CMB.1.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctatttcagttatttagcctggtatcagacaaaaacaggaaancccctaagctcctgatctanggtgcatccactttgcaaagtcgggtcccatcaaggttcagcggcagtgatcgtgggacagtatttcactctcacatcagcagcctanagcctagaagtntttgactaatttattacgtgtacaactagtacctttaaataactttaccgacgtccttacgtacgttttaccgggacgggtaacgggaacccgtaaaggggttacgggaaacgtaacgttaacgaaaaacccggtaacgttacgggttacgggtacccttaacggccctaaaacccgtgttcccgtttaccgg

SEQ ID NO: 18825 - DNA, 556 bp, Homo sapiens
  misc_feature: GYAE6OF01CTKOQ.4.10.A10.1.454.CMB.1.raw
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggctattttcagttattagcctggtatcagacaaaaccagggaaacncccctaagctcctgatctatgngcatcctactttgactaaaggtcggggtacccagtacaaggttcaaggcggacaggtggatcgtagggacagtacttcactctcaccatcagcacgcctacacgtcctagaagtattttcgactaacttattactgtaccaatagtaacttaattaattacgctcttaccgtacgtttcgggacggtaacgggaccgtaagggtaggaagtaataacgaaacgtaacgttgggtacggtacgtacgaccaacctgttcgttacg

SEQ ID NO: 18826 - DNA, 566 bp, Homo sapiens
  misc_feature: GYAE6OF01A8AYA.4.10.A10.1.454.CMB.1.raw
  modified_base (271)..(271): a, c, t, g, unknown or other
  misc_feature (271)..(271): n is a, c, g, or t
  modified_base (379)..(379): a, c, t, g, unknown or other
  misc_feature (379)..(379): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacncccctaagctcctgatctatggtgcatcctactttgacaaaggtcgggtcccagtcaaggttcaggcggcaggtggatcgtgggacagtattcactctcaccatcgancagccctacacgcctagaagtatttgactaacttattaactgtaccaactagtacttaaataagttaccgcgtcttacgtacgtttccggggacgggtaacgggtacccgaaaggggttcgggaaacgtagtaaccgaaaacggaacgttaggtacggtacctacggacctaaccgtattcgttacg

SEQ ID NO: 18827 - DNA, 521 bp, Homo sapiens
  misc_feature: GYAE6OF01CUQC7.4.10.A10.1.454.CMB.1.raw
  modified_base (185)..(185): a, c, t, g, unknown or other
  misc_feature (185)..(185): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (497)..(497): a, c, t, g, unknown or other
  misc_feature (497)..(497): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctanaggagacagagtcaccatcacttgccgggcagtcagggcattttcagttattagctggtatcagacaaaaaccagggaaancccctaagctccngatctatggtgcatccactttgcaaaagtggggtcccatcaaaggttcaaggcgcagtggatctgggacngaatttcactctcaccatcagcagcctacagctgaanttttgnaacttattactgtccaaanagtaattaataactacgacgtctactacgttcgggacgggtaacgggaaaccaagggtaggaagaataacgaaaaccgtaacgtgnggtactagaccaacctatcgttcg

SEQ ID NO: 18828 - DNA, 546 bp, Homo sapiens
  misc_feature: GYAE6OF01CSJUO.4.10.A10.1.454.CMB.1.raw
  modified_base (194)..(194): a, c, t, g, unknown or other
  misc_feature (194)..(194): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (514)..(514): a, c, t, g, unknown or other
  misc_feature (514)..(514): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtcctccattccctccctgtctgcatctatagganacagagtcaccatcacttgccggcagtcagggctattttcagttatttagcctaggtatacaagacaaaaaccgagggaacgacccctaagcctacctagacttctatggtagctactcctatttgactaaaggtcgggtacccagtacgaaggttcaggcgtcaggtcggatcgtaganactagtatttcacttcacacatcagcacgtcctaagacnctagaattatttcgacttaactttactactacgtacaaactagttacttaaatacttaccgctactactacgtttcgggacgagggaccaagggtcgtaanatacgaaacgagtgacgtactanccactntcg

SEQ ID NO: 18829 - DNA, 573 bp, Homo sapiens
  misc_feature: GYAE6OF01CR6ED.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgcccctaagctcctgatctatggtgcatccactttgcaaagtcggggtcccatcaaggttcagcggcagtggatcgtggggactagtatttcactctcaccatcagcagccctacagcctagaagtattttagacctaactttattactgtaccaactacgtactttaaataacttacgacgtacttacctacgtttaccgggaccgggtaacgggaccgtaaaggggtcggaacggtaacttaaccgaaaaccggtaccgtagggttacggtaccgttacggacccaacccgtgttccgttacg

SEQ ID NO: 18830 - DNA, 811 bp, Homo sapiens
  misc_feature: GYAE6OF01CWXKR.4.10.A10.1.454.CMB.1.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctagtaggagacagagtcacatcactgccggcagtcgagggctattttcagttattagcctggtatcagacaaaacgaggaacnccctaagcctactgatctatggtnctatcctagtttgacgtaaaggtcgggtaccctaagtaccgtaaaggttccgaaggtccggtacgtaagggttacgggtaacgtaccggtagggggtaaacctaacgggtttaacttttaccgaaacccgtttcccgttaacccgaaccctaacgttacccggaaccggtacctaacgggtaccccctttaaacgaccgggtaacccgttaagggtaaaacgttttaacgttttttacggaaacccttttaaaacgtttttaactttaaccgttacggttaaaccctaaaaacgtttacggttaaaaccctttttaaaacggttaaaccgtttaacccggtacccggttaacctttaacccgggtttaacccggttttaaccggggggaccggggtaaaaccggggtaaacccgttaaaggggttaaccgggaaacgttaaacccgttaaaccggtaaaaaccggtaaccggtttgggtaaccgggtactacggaaccctacccggtaattcgtttaacccg

SEQ ID NO: 18831 - DNA, 508 bp, Homo sapiens
  misc_feature: GYAE6OF01ENHC1.4.10.A10.1.454.CMB.1.raw
  modified_base (267)..(267): a, c, t, g, unknown or other
  misc_feature (267)..(267): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctcctgtctgcatctataggagacagagtcaccatcacttgccgggccagtcagggcattttcagttattagcctggtatcagacaaaaaccagggaaancccctaagctcctgatctatggtgcatccactttgacaaagtcggggtcccatcaaggttcagcggcagtggatctgggacagtatttcactctcaccatcagcagcctacagcctagaagtattttgactaactttattactgtacaactagtacttaataattacgctctcacgtttcgggacggagggaccaagggtggagatacaaacgaacgtggtacggctaggaccacatctcg

SEQ ID NO: 18832 - DNA, 593 bp, Homo sapiens
  misc_feature: GYAE6OF01DMWZ0.4.10.A10.1.454.CMB.1.raw
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatcctcctgtctgcatctataggagacagagtcaccatcacttggccgggcagtcagggctagttttcagtttattagcctggtatcaagacaaaaaccgagggaaacgcccctaagcctcctagactctagtggtncatcctactttgctaaaaggtcggggtacccattaccgaaaggttccgaggccgganagtcggatcgtagggacagtatttcactctacacatcancanccctanacgctagaagtatttgactaatttacttaactgtaccaaatgtaacttaaagtaagttaccgcgtacttaccgtacgtttaccgggagggaaccggtaacccgtaagggtacgggaacgtaataaccgtaaaaccggacttaggttccggggacttacgggacccacccttaagttccgttaacgg

SEQ ID NO: 18833 - DNA, 527 bp, Homo sapiens
  misc_feature: GYAE6OF01ADUTR.4.10.A10.1.454.CMB.1.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
  modified_base (519)..(519): a, c, t, g, unknown or other
  misc_feature (519)..(519): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagcaaaaaccngggaaacncccctaagctcctgatctatggtncatccactttgactaaaggtcggggtacccagtcaaggttcaggtcggcaggtggatcgtgggacagtatttcactctacaccatcagcacgccctacacgtcctagaacgtattttacgacttaactttattactgtacaactagtacttaataacttacgctctactacgtttcggacggaggaccgaaggtcggatatacaaagactggtacgctagaccactntcgttacg

SEQ ID NO: 18834 - DNA, 643 bp, Homo sapiens
  misc_feature: GYAE6OF01BH0YW.4.10.A10.1.454.CMB.1.raw
  modified_base (192)..(192): a, c, t, g, unknown or other
  misc_feature (192)..(192): n is a, c, g, or t
  modified_base (302)..(302): a, c, t, g, unknown or other
  misc_feature (302)..(302): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctccatccctccctgtctgcatctatagganacagagtcaccatcacgttcggccgggccagtcgagggtctatttcagtttattagcctggtatcagaacaaaaaccgaggaacacccctaagctcctgatctagtggtnctactctactttgacgtaaggtcgggtaccctagtacgtaaggttcaacggcggtacgaggtcggtaacttcggtacggggactagttactttaccaaccttcctaccacctataccgaagaccacgaccctaacgacgtacctaggtaacgttagttttcgaactttaacgttattaacttcgtaactaactaacgtaactttaagttaaacgttccgacgttacttaccgtacggtttccggggaacgggtaaccgggtaccgtaaagggtacggaagtaacgtaaacggtaaaacgtacgttaggacggttactaccgtacaccctgttcccgttacg

SEQ ID NO: 18835 - DNA, 666 bp, Homo sapiens
  misc_feature: GYAE6OF01BQTMB.4.10.A10.1.454.CMB.1.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatggtgccatccgagttcgacccagtctccatcctcctgtctgcatctataggagacagagtcaccatcacttcgccgggccagtcgagggtctattttcagttattagcctggtatcagacaaaacgaggaacnccctaagcctcgtgactctagtggtacnctactcctacgttgacgtaaggtcgggtaccctagtcgtaacggttcgaacggcggataggtggacgtcggtacgggtactagtacttttaccgaccgttctaccgaacgtactaccgaacgtccgtaacgtcccgtaacgacgtaccgtaggtaacgtttacgttttaacgacctttaaacgtttattaaccgttacgtaaccgtaaacgttaacggttaacctttaaacgtaacgttaccgtaccggttaccttaccggttaccggttccggggaaccggtaagggtaaccgtaaagggtcggtaactacgtaaaccgtaaacggacgtgggtacgtcgtacgtaccgacttcggtccgttacg

SEQ ID NO: 18836 - DNA, 829 bp, Homo sapiens
  misc_feature: GYAE6OF01AJMS2.4.10.A10.1.454.CMB.1.raw
  modified_base (190)..(190): a, c, t, g, unknown or other
  misc_feature (190)..(190): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttcggccgggccagtcgagggctattttcagtttattagcctggtatcagacaaaaaccgaggaaacgccctaagcctcctgatctagtggtcnctactcctactttgactaaggtcgggtaccctagtacgtaaggttcgaacggcggtacgtagggtcggtaactcggtagggaactaggttacttttacccgacctttccgtaccaaccctacgtaccgaacgtaccgtaaccggtaccccttaaccgaccggtacccgttaaggttaaaccgtttaacttttttacgggaaaccctttaaaactttttaaccgttttaaccgttaacggtttaaaccctaaaacccgttaaggtttaaccctttttaaaaacgtttaaaccggttttacccggtaccggttacccgtttaacccggtttaacccgggttttacccgggggaaccgggggttaaacgggggtaaaccccggttaaaggggggttaacccgggtaaaacggttaacccgggttaaacccggtaaaaaaccccgggttaaacgggtttaccgggttaaccgggtacccggttacccggtaaaccccttaacccggtttaaacgtttcccggttttaacccgg

SEQ ID NO: 18837 - DNA, 571 bp, Homo sapiens
  misc_feature: GYAE6OF01ECYHQ.4.10.A10.1.454.CMB.1.raw
  modified_base (273)..(273): a, c, t, g, unknown or other
  misc_feature (273)..(273): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcagggctattttcagtttatttagcctggtatcagacaaaaaccgagggaaacncccctaagcctcctgatctagtggtgcatcctactttgactaaaggtcgggtcccatcgaaggttcagcggcaggtggatcgtagggacagtattcactctacaccatcagcacgaccctacacgcctagaacgttattttcgaccgttactttacttacttacgtacaactagtaactttaaagtaacttaccggctaccttacgtacgtttcgggacgggtaacgggaccgtaaggggtaggaacgtacgtacgaaacgtaacgtggtacggctacgacctaccgtattcgttacg

SEQ ID NO: 18838 - DNA, 544 bp, Homo sapiens
  misc_feature: GYAE6OF01COZ20.4.10.A10.1.454.CMB.1.raw
  modified_base (293)..(293): a, c, t, g, unknown or other
  misc_feature (293)..(293): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaccgaggaaacgcccctaagctcctgatctatggtncatcctactttgacgtaaaggtcggggtacccagtacgaaggttcaggcggcaggtggatcgtagggactagtatttccactctcaccatcagcacgccctaacacgtcctagtaagtattttcgacttaactttattactgtacaactatacttaaatacttacgctctacgtcgttcgggcggtacggaccgaagggtaggagtaactaacgaaacgacttggcgtactacgaccaccctgttcgttcg

SEQ ID NO: 18839 - DNA, 600 bp, Homo sapiens
  misc_feature: GYAE6OF01D6ULZ.4.10.A10.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccggccagtcagggctattttcagttatttagccgttggtatcaagacaaaaaccgagggaaacncccctaagcctcctgattctatggtncatcctatttgactaaaggttcgggaccctaagtcgaaaggttcaaggccggcgtaggtgggatcggtagggacagttacttcgactctacacatcagcaacgccctaacagtcctagtaacgttacttttgaccttaaactttacttacttcgtactaactagtacttaaataacgttaccgctacgttactacgtttcggggacggtaacgggtaaccgaaagggtcgggaaacgtaacgtaaccgaaaacggtagttcggtacgggtacctacgacctaaccgtattccggttacg

SEQ ID NO: 18840 - DNA, 538 bp, Homo sapiens
  misc_feature: GYAE6OF01DLAK3.4.10.A10.1.454.CMB.1.raw
  modified_base (529)..(529): a, c, t, g, unknown or other
  misc_feature (529)..(529): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggcatttcagttattagcctggtatcagacaaaacgaggaaagcccctaagctcctgatctatggtgcatcctactttgacaaaggtcggggtcccaagtcaaggttcagcggcagtggatcgtgggacagatttcactctcaccatcagcagccctacagcctgaatattttgactaactttattactagtacaactagtactttaaattaacttaccgcgtaccttacgtacgtttcgggacggtaacgggaccgaagggtggaaagatacgaaaacgtacgtggtacggtctacggacctaaccnttcgttacg

SEQ ID NO: 18841 - DNA, 613 bp, Homo sapiens
  misc_feature: GYAE6OF01B37J4.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacgcccctaagcctcctgatctatggtgctactcctacttttgacgtaaaggtcggggtaccctagtacgtaaaggttcaacgggcgggaccgaggttcgggtaacttcggtaggggaactaaggtattttacccgaacttccgtacaaccctataccgaacgaccaacggacccctaacgacgaccgtagtaaacgttatttttagacttaactttatttactagtacaactagtacttaaataacttacgctctctacgtttcgggacggtagggaccgtaagggtggaagtagtaacgtaaaacggacgttggtacggtactacgaccacctatccgttacg

SEQ ID NO: 18842 - DNA, 534 bp, Homo sapiens
  misc_feature: GYAE6OF01EL2RF.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgcccctaagctcctgatctatggtgcatccatttgcaaagtcgggtccatcaaggttcagcggcaggtgatcgtgggacagtattcactctcaccatcagcagtccctacagcctagaagtattttcgactaactttattactagtacaactagtactttaaataacttacgcgtctactacgtttcgggacggtaagggtacccaaagggtggaagtagtaacgaaacgtaacgtgtacggtctacgacctacctattcgttacg

SEQ ID NO: 18843 - DNA, 555 bp, Homo sapiens
  misc_feature: GYAE6OF01E0TXK.4.10.A10.1.454.CMB.1.raw
  modified_base (535)..(535): a, c, t, g, unknown or other
  misc_feature (535)..(535): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctcctgtctgcatctataggagacagagtcaccatcacttgccgggccagtcagggctattttcagttatttagcctggtatcaagacaaaaacgaggaaacgcccctaagctcctgattctagtggtgctactcctactttgactaaaggttcggggtacccagtccgaaaggttcaggtcggctaggtggactcgtagggacagtattcactctacaccatcagcacgcctacacgcctagaagttattttgacttaacttattactgtacaactagtacttaaataattaccgcgtactactacgtttcgggacggtaggtaccgaagggtggaacgataaccgaaacgtaacgtgtacggtacngaacccactagttcgttacg

SEQ ID NO: 18844 - DNA, 550 bp, Homo sapiens
  misc_feature: GYAE6OF01DLDJ7.4.10.A10.1.454.CMB.1.raw
  modified_base (271)..(271): a, c, t, g, unknown or other
  misc_feature (271)..(271): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccgagggaaacncccctaagcctacctgatctatggtgcatcctatttgactaaagtcggggtacccatcaaggttcagcggcaggtggatcgtagggacctagtactttcactctacacctatcagcacgcctanagcctgaatatttgactacttattactagtacaanacgtacttaaatactttacgacgtcttacgtacgtttaccgggacgaaggggacccaagggtcggaagtacttaacgaaacggtaacttggacggtctacgactaacccagttccttacg

SEQ ID NO: 18845 - DNA, 582 bp, Homo sapiens
  misc_feature: GYAE6OF01CNDGU.4.10.A10.1.454.CMB.1.raw
  modified_base (296)..(296): a, c, t, g, unknown or other
  misc_feature (296)..(296): n is a, c, g, or t
  modified_base (499)..(499): a, c, t, g, unknown or other
  misc_feature (499)..(499): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcagggcattttcagttattagcctggtatcaagacaaaaccgaggaacgaccctaagcctacctagactctaagtggtnctatcctagtttcgactaaaggtcgggtaccctagtacgaaggttcaggtcggctaggtggactcgtagggactagtatttacactctacactatcagacacacctaacacgtacctagaagtattttcgactaacgtttacttactgttaaccaacgtagtaacttaattaacgtaccgacgtacttacgtacgttaccggnggtaacgggaaccgtaagggtaggaacgtagtaacgaaacggtaacttgggtacggtactacggacctaacgtatccgttacg

SEQ ID NO: 18846 - DNA, 522 bp, Homo sapiens
  misc_feature: GYAE6OF01D4LEP.4.10.A10.1.454.CMB.1.raw
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (483)..(483): a, c, t, g, unknown or other
  misc_feature (483)..(483): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccgaggaaagcccctaagctcctgatctatggtgcatccactttgacaaagtggggtcccagtcaaggttcagcggcagtggatcngggacagatttcactctcacatcagcagccctanagcctagaagtattttagacttaacgttatttactgtaccaactagtactttaataattacgacgtcttcacgtttacgggcggagggaccgaagggtggagtanacgaaacgaactgtaggtctaggaccacctatcgttacg

SEQ ID NO: 18847 - DNA, 565 bp, Homo sapiens
  misc_feature: GYAE6OF01CC3BE.4.10.A10.1.454.CMB.1.raw
  modified_base (292)..(292): a, c, t, g, unknown or other
  misc_feature (292)..(292): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcgagggctattttcagttatttagctggtatcagacaaaacgagggaacgcccctaagctcctagatctatgtnctatcctatttgacgtaaaggtcgggtacccagtacgaaggttcacggcggacaggtggatcgtagggactagtactttcactctcaccatcagcacgccctacacgtacctagaacgtattttacgacttaactttattactgtacaactagtacttaataacttacgctaccttacgtacgttcggacggtacgggacctaagggtcggaacgtaagtaaccgaaacggtacgttgggtacggtacctacggaccaccgtagttcgttacg

SEQ ID NO: 18848 - DNA, 596 bp, Homo sapiens
  misc_feature: GYAE6OF01C99Q1.4.10.A10.1.454.CMB.1.raw
  modified_base (274)..(274): a, c, t, g, unknown or other
  misc_feature (274)..(274): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttcgccgggcagtcagggctattttcagttatttagcctggtatcaagaccaaaaacgagggaaacncccctaagctcctgatctatggtgcatcctactttgactaaaggtcggggtcccaagtcgaaaggttcaggcggctaggtggactcgtagggacaggtatttccactctacaccatcacgacagtccctaacagtacctagaagttatttcgacttaaacttagttactgtacaaactgtaacttaaataacttaccgacgtcttaccgtacgtttaccgggacgggtaacggaaaccgtaaaggggttcggaaagtaacgttaacgaaaaaccggtacgttacggtcgggtactacggacccaaccgttagtccgtttacg

SEQ ID NO: 18849 - DNA, 584 bp, Homo sapiens
  misc_feature: GYAE6OF01CUSOE.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacgcccctaagctcctgatctatggtgcatccatttgacaaagtgggtcccatcaaggttcagcggcagtggatcgtgggacagtatttcactctcaccatcagcagccctacagcctagaagtattttgactaactttattactgttacaactagtacctttaaataaacttacgcgtacttacgtacgttttaccggggacgggtaacgggaacccggtaagggttacgggaaagtaacgttaaccggaaaaaaccgggttaaccgttagggttacgggaccgttacggaccctaaccctagttccctttacgg

SEQ ID NO: 18850 - DNA, 560 bp, Homo sapiens
  misc_feature: GYAE6OF01BD6CA.4.10.A10.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (403)..(403): a, c, t, g, unknown or other
  misc_feature (403)..(403): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcagggcattttcagttatttagcctggtatcaagacaaaaaccagggaaacgcccctaagctccngatctatggtncatccatttgacaaagtcgggtacccatcaaggttcaggcggntaggtggatcgtgggacaggtactttcacttcctacaccatcagcacgcctaacagacctagaatntttgactaactttatactgtaccaacataacttaataattacgacgtacttacgaccgtttcgggaccgggtaagggaccgtaaagggtcggtaaacgtagtaaccgaaaacgtaacgttggtacggtactacggacctaaccctagtcgtttaccg

SEQ ID NO: 18851 - DNA, 539 bp, Homo sapiens
  misc_feature: GYAE6OF01DFSI2.4.10.A10.1.454.CMB.1.raw
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacncccctaagctcctgatctatggtnctatcctactttgactaaagtcgggtcccatcaaggttcagcggcagtggatcgtgggacagtacttcactctcaccatcagcacgcctacacgtcctagaatattttcgactaacttattactgtacaactagtacttaaataacttacgctactacgtacgtttcgggacggtaacgggaccgtaagggtggaagtaatacgaaaacgtacgtggtacggctacgacctacctgtcgttacg

SEQ ID NO: 18852 - DNA, 543 bp, Homo sapiens
  misc_feature: GYAE6OF01BFMMH.4.10.A10.1.454.CMB.1.raw
  modified_base (295)..(295): a, c, t, g, unknown or other
  misc_feature (295)..(295): n is a, c, g, or t
  modified_base (535)..(535): a, c, t, g, unknown or other
  misc_feature (535)..(535): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccagggaaacgcccctaagctcctgatctatggtncatcctactttgacaaaggtcgggtcccatcgaaggttcagcggcagtggatcgtgggacagtatttcactctcaccatcagcacgcctacacgcctagaagtattttcgactaactttattactgtacaactagtacttaaatacgttacgccgtcttacgtcgtttacgggcggtaacgggtacaaggggtcggaagtactacggaaaaccgacgtggtacggcttacgcctaacctnttcgttcg

SEQ ID NO: 18853 - DNA, 522 bp, Homo sapiens
  misc_feature: GYAE6OF01A9QCI.4.10.A10.1.454.CMB.1.raw
  modified_base (270)..(270): a, c, t, g, unknown or other
  misc_feature (270)..(270): n is a, c, g, or t
  modified_base (428)..(428): a, c, t, g, unknown or other
  misc_feature (428)..(428): n is a, c, g, or t
  modified_base (516)..(516): a, c, t, g, unknown or other
  misc_feature (516)..(516): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaacncccctaagctcctgatctatggtgcatccactttgacaaaggtcgggtcccatcaaggttcagcggcagtggatcgtgggacagtatttcactctacaccatcagcagtccctacgagtcctagaagtattttcgactaactttattactgtacaacngtacttaaatacgttacgcgtctactacgttcgggacggtacgggaccaagggtggagtatacgaaacggactggacgctgaccactntcgtcg

SEQ ID NO: 18854 - DNA, 577 bp, Homo sapiens
  misc_feature: GYAE6OF01C7PUA.4.10.A10.1.454.CMB.1.raw
  modified_base (276)..(276): a, c, t, g, unknown or other
  misc_feature (276)..(276): n is a, c, g, or t
  modified_base (569)..(569): a, c, t, g, unknown or other
  misc_feature (569)..(569): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggctattttcagtttatttagccttggtatcaagacaaaaaccagggaaacncccctaagctcctagatctagtggtgctatcctatttgacgtaaaggtcgggtcccagtaccgtaaggttcaggtcggactaggtggagtcgtagggactagtactttcactcctacaccatccagccagtccctacagtcctagaagtacttttgaaccttaactttattacctgtaccaactacgtacttaagttaacttcgacgtacttccgtacgtttcgggaccggtaagggaccgtaagggtcggataacgtacgaaacggtacgtggtacggtcctagcccaactnttcgttcg

SEQ ID NO: 18855 - DNA, 585 bp, Homo sapiens
  misc_feature: GYAE6OF01CPDR3.4.10.A10.1.454.CMB.1.raw
  modified_base (268)..(268): a, c, t, g, unknown or other
  misc_feature (268)..(268): n is a, c, g, or t
  modified_base (566)..(566): a, c, t, g, unknown or other
  misc_feature (566)..(566): n is a, c, g, or t
tcagagcactgtagcacgaccggtgctcgatttagcgtcgatctcgagggggagtcagtcccagtcaggacacagcatggacatggagggtccccgctcagctcctggggctcctgctgctctggctcccaggtgccagatgtgccatccagttgacccagtcctccatccctcctgtctgcatctataggagacagagtcaccatcacttcgccgggcagtcaggctatttcagttattagctggtatcagacaaaacgagggaacnccctaagctctagatctatcgtgactactcctaactttgacgtaaaggtcgggtacccattaccgaaggttcgaagtcggactacggtaggtactacgtagggtacaggtatttcactctacactaatcacgacacgtccctaagacgtaccgtagtaaagttagttttacgaaccttaactttaacttacgttagtaacaactagttaaccttaaataacgttacgtcgacttacgtacgttcggacggtaggaccgtaagggtgaacgtatacgaaaacgtacggtgtacggtacncgacaccgtattccttacg

SEQ ID NO: 18856 - DNA, 570 bp, Homo sapiens
  misc_feature: GYAE6OF01A9PQG.4.10.A10.1.454.CMB.1.raw
  modified_base (298)..(298): a, c, t, g, unknown or other
  misc_feature (298)..(298): n is a, c, g, or t
  modified_base (561)..(561): a, c, t, g, unknown or other
  misc_feature (561)..(561): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggctattttcagttatttagcctggtatcagacaaaaaccgagggaaacgcccctaagcctcctgatctatggtncatcctactttgacaaaggtcgggtcccagtcgaaggttcaggcggcagtggatcgtagggacagtatttcactctcaccatcagcacgccctaacgacgtcctagaagtattttacgacttaactttattaactgtacctaactagtaactttaaataacttaccggcttacctactaccgtttcgggaccggtaacggggacctaagggtggaacgtacgtaacgaaacggtacgtgggtacggtcttacgaccaaccgtnttcgttacg

SEQ ID NO: 18857 - DNA, 621 bp, Homo sapiens
  misc_feature: GYAE6OF01CI7HT.4.10.A10.1.454.CMB.1.raw
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggccagtcagggctattttcagtttatttagcctggtatcaagacaaaaaccgagggaaacncccctaagctcctgactctagtggtnctatcctacgtttgacgtaaaggtcggggtacccagtacgtaaggttcaggcggactaggtggactcgtgggactagtatttcactctacacctatcagcacgccctacgacgtacctaggtaacgttagttttcgaaccttaaactttactttactacgtaacctaacgtacgttaacctttaaattaacgttaccgacctaccttaccgttacgtttaccggggacggtaacgggtaccgaaagggttcggaaacgtacgtaacgaaaaccggtacgttagggtacggtaccttagaacccgtaacctgttccgttacg

SEQ ID NO: 18858 - DNA, 609 bp, Homo sapiens
  misc_feature: GYAE6OF01DCCAK.4.10.A10.1.454.CMB.1.raw
  modified_base (267)..(267): a, c, t, g, unknown or other
  misc_feature (267)..(267): n is a, c, g, or t
tcagagcactgtagcacgaccggtgctcgatttagcgtcgatctcagggggagtcagtcgcagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcaggctattttcagttattagcctggtatcagacaaaaccgaggaaacncccctaagcctacctgactctatggtcgctactccctatttagactaaaggtcgggtaccaagtcgtaaaggttcaaggcggacgtagtggatcgtgggtactaggtatttccaacttctacacatacgagccagtcctaacgacgccgttagtaaagttattttacgacttaacgtttattaccttgtaaccaaactagttaaccttttaaagtaactttaccggaccttaccttacgttaccggttttaccggggaccggtaacggggaacccgtaaggggtacggaactacgtaaccgaaaacgtacgttaggtcgtacgttgaccctacgtattacgg

SEQ ID NO: 18859 - DNA, 592 bp, Homo sapiens
  misc_feature: GYAE6OF01CXFSD.4.10.A10.1.454.CMB.1.raw
  modified_base (271)..(271): a, c, t, g, unknown or other
  misc_feature (271)..(271): n is a, c, g, or t
  modified_base (370)..(370): a, c, t, g, unknown or other
  misc_feature (370)..(370): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgctgggccagtcagggctattttcagttattagcctggtatcagacaaaaaccgagggaacncccctaagcctcctagatctagtggtcgcacttacctactttagacgtaaagggtcggggtacccatcgtaaagggttcaggcggacaggtggattcgngggactaggtatttcacttctacaccatcagcagcctacagcctagaacttatttacgacttaactttacttactagtactaacgtagtactttaaattattaccgcgtacttacgtaaccggtttccgggacgggtaacgggtaaccgtaaggggtacggaagtaactaaccgaaaaccggtacgttacggtacggtactaggacctaccgtactttaccg

SEQ ID NO: 18860 - DNA, 540 bp, Homo sapiens
  misc_feature: GYAE6OF01B1WR2.4.10.A10.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggacagtcgagggctattttcagttattagcctggtatcagacaaaaaccgaggaaacgcccctaagcctccgtgacttctatggtcgacactcctacgtttgacgtaaaggttcggggtacccatacgtaaggttcagcggcaggtggactcgtgggacagtattcactctcacntcagcagccctacngtacctgaagtntttgactaacttattactntacaatntacttaatacttacgcgtctacgtacgttcgggcggtaaggtaccgtaaggtcggaagtatacgaaacggtagttgacggtactacgacacgtgtcgtacg

SEQ ID NO: 18861 - DNA, 515 bp, Homo sapiens
  misc_feature: GYAE6OF01AKU70.4.10.A10.1.454.CMB.1.raw
  modified_base (388)..(388): a, c, t, g, unknown or other
  misc_feature (388)..(388): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacgcccctaagctcctgatctatggtgcatccactttgactaaaggtcgggtcccatcaaggttcagcggcagtggatcgtgggactagtatttcactctcaccatcagcacgcctaacncgcctagaagtattttcgactaactttacttacttgtaccaactagtactttaataacttacgcgtctactacgtttcggacggaggacctaagggtggacatacaacgatgnggctgcacntctcg

SEQ ID NO: 18862 - DNA, 617 bp, Homo sapiens
  misc_feature: GYAE6OF01AM4RG.4.10.A10.1.454.CMB.1.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctcctgtctgcatctataggagacagagtcaccatcacttgccgggcagtcaggctattttcagttattagccttggtatcagacaaaacgagggaaacnccctaagctcctgactctagtggtnctactcctactttgacgtaaaggtcgggtacccaagtcgtaaaggttcaaggcggacgaggtacggatcggtagggactagtacgtttcacgttctaccacactccgagcacgtacctacgacgtaccgtagtaagtacttttacgaccttaaacttacttactcgtaactaactagtaaccttaataacgttacgtacgtcttacgtacggtttccggggaacggtaacgggtaaccgtaacgggttacggaacgtaacgttaaccggtaaacggtaaaccgttgggtacggttacgacgtaaccaccgtaattccgttacgg

SEQ ID NO: 18863 - DNA, 587 bp, Homo sapiens
  misc_feature: GYAE6OF01B111U.4.10.A10.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttggccgggccagtcgagggctattttcagttattagcctggtatcagacaaaaaccgaggaaacncccctaagcctcctgatctagtggtncatcctatttgacgtaaaggtcgggtacccatacgaaggttcaggcggacaggtggactcgtagggactagtactttcacttccacaccataccagcacgaccctaacgacgtcctagaagttattttacgacttaactttattactatacaactagttaacttaaagtacttaccgcgtaccttacgtaccggtttacgggacgggtaacgggtaaccgtaaggggtcggtaacgtaagtaaccgaaacgacgttggtacggtctacgaccacctgttccgttacg

SEQ ID NO: 18864 - DNA, 773 bp, Homo sapiens
  misc_feature: GYAE6OF01CP3AV.4.10.A10.1.454.CMB.1.raw
  modified_base (527)..(527): a, c, t, g, unknown or other
  misc_feature (527)..(527): n is a, c, g, or t
tcagagcactgtagcacgaccggtgctcgatttagcgtcgatctcgagggggagtcagtcccagtcaggacacagcatggacatggacgggtccccgctcagctccgtggggctcctgctgctctggctcccaggtgccagatgtcgccatccagttcgacccagtcctccactccctccctgtctgcatctagtaggagacagagtccaccatcacgttcggccgggccagtcgaggtcttatttctagtttatttacgccttaggtactacgaacgaaaccgaaaaaccggaacggggaaaaccgtacccccgtaaaggtcccttaccgtagtaacttaccgtaagttcgggtacgtacctacgttaccctacgtttacggaacgtaaacggggtcgggtacccaagttaccgtaaaggtcgagggcggtacgtaggtcggtacgttcggtagggtaactaggttacttcgaccttcacctaccatccgacgaccacgtacctacgacgtaccgtagtaacgttntttacgaactttaactttacgttacgtactaaccaacgttaacgtaactttaaacgtttaacgtaccggtaccgttaccgttacggtaccgggtttaccggggaacggggtaacccgggtaaacccgggttaaggggtaaccggtaaacggtaaaccgttaaacccggtaaaaccggttaccggttacggggtacggtaacccggtttacggaaccccgttaacgtaccgtttccgtttaacccgg

SEQ ID NO: 18865 - DNA, 543 bp, Homo sapiens
  misc_feature: GYAE6OF01B0504.4.10.A10.1.454.CMB.1.raw
  modified_base (190)..(190): a, c, t, g, unknown or other
  misc_feature (190)..(190): n is a, c, g, or t
  modified_base (535)..(535): a, c, t, g, unknown or other
  misc_feature (535)..(535): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacatagtcaccatcacttgccggccagtcagggcattttcagttatttagcctggtattagacaaaaaccgagggaaacgcccctaaagctcctgatctatggtgctatcctactttgactaaaggtcggggtacccagtcaaggttcagcggcaggtggatcgtgggacagtatttcactctcacatcagcacgcctacacgcctagaagtattttcgacttaaactttattactgtactaacagtactttaaataacttacgccgtactacgtacgtttcgggacggtacgggaccgtaaggtggaagtactacgaaacggtactggtacgctacgccaactnttctgttc

SEQ ID NO: 18866 - DNA, 546 bp, Homo sapiens
  misc_feature: GYAE6OF01AGNR6.4.10.A10.1.454.CMB.1.raw
  modified_base (539)..(539): a, c, t, g, unknown or other
  misc_feature (539)..(539): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaccgagggaaacgcccctaagctcctgactctagtggtgcactcctactttgacgtaaaggtcggggtacccagtcgaaggttcaggcggcaggtggatcgtgggacagtactttcactctcaccatcagcacgccctacgacgccgtagaacgttattttagaccttaactttattactagtaccaactagtaacttaataacttacgctcttactacgttcgggcggtaggaccgtagggtcggagtatacgaaacgtacgtggtcgctacgaccactntcgttcg

SEQ ID NO: 18867 - DNA, 635 bp, Homo sapiens
  misc_feature: GYAE6OF01BEYN0.4.10.A10.1.454.CMB.1.raw
  modified_base (191)..(191): a, c, t, g, unknown or other
  misc_feature (191)..(191): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctatagganacagatcaccatcacttgccggcagtcaggctatttcagttattagcctggtatcagacaaaaccgagggaacgccctaagctcctgatctatgtgctatcctactttgactaaaggtcggggtacccagtcgaaggttcagtcggatacggtggacttcgtagggactagtactttacacctctaccgaacctacttaccgaacgtaccgaacggtaccccttaacgaacgtacccgtaggtaaagttacgtttttacgaaaccttaaaccttttaatttaccgttaacgttaccgtaaaacgtacggttaaactttaaattaacgtttaaccgccgttacttacccgttaacggtttccgggaacgggtaacggtaccgtaagggtacggaacgtaataacgaaacggtaacgtgtacggtactgacctactagtcgttacg

SEQ ID NO: 18868 - DNA, 537 bp, Homo sapiens
  misc_feature: GYAE6OF01AVX82.4.10.A10.1.454.CMB.1.raw
  modified_base (260)..(260): a, c, t, g, unknown or other
  misc_feature (260)..(260): n is a, c, g, or t
  modified_base (377)..(377): a, c, t, g, unknown or other
  misc_feature (377)..(377): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagctggtatcagacaaaaaccngggaacgcccctaagctcctgatctatggtgcatccactttgctaaagtgggtcccatcgaaggttcagcggcagtggatcgtgggacagtatttcactctcacatcagcagcctanacgcctaggaatattttgactaactttatactgtaccaactagtaccttaataacttacgacgtcttactacgtttcgggcgggtaggtacccgtaaagggtgaacgtaattaccgaaaacgtaccgtggtacggtactagacctaccgagttcgttacg

SEQ ID NO: 18869 - DNA, 529 bp, Homo sapiens
  misc_feature: GYAE6OF01B4AUM.4.10.A10.1.454.CMB.1.raw
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (524)..(524): a, c, t, g, unknown or other
  misc_feature (524)..(524): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctcctgtctgcatctataggagacagagtcaccatcacttgccgggccagtcagggctattttcagttatttagccttggtatcaagacaaaaaccgagggaaacgcccctaagctcctgatctatggtncatccactttgacaaaggtcgggtcccatcgaaggttcagcggacaggtggatcgngggacagtatttcactctcaccatcagcacgccctacacgtcctagaagtattttgacttaacttattactgtacaactagtacttaaataacgttacgcgtactctacgttcgggcggaggaccgaagggtggagatacgaaacgacgtggtacggtctacgacacctntctcg

SEQ ID NO: 18870 - DNA, 649 bp, Homo sapiens
  misc_feature: GYAE6OF01A3HRV.4.10.A10.1.454.CMB.1.raw
  modified_base (295)..(295): a, c, t, g, unknown or other
  misc_feature (295)..(295): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacgcccctaagctcctgatctatggtncatccatttgacgaaaggtcggggtacccagtcaaggttcagcggcagtggatcgtgggacagtactttcactctacacctatacagcacgtcctaacacgtcctaggaacgttattttcgaccttaacgtttactttacttacgtaacctaaactacgttaacctttaaacgttaacgtttaacccggtaccgttaccctttaccgttacccggtttttaccgggggaccggggtaaacggggtaaacccgtaaagggggttaccgggtaaacgtaacgttaaacggaaaacccggtaacgttcggggtacggtaccgttacggaccctaacccgttagttcccgtttaccgg

SEQ ID NO: 18871 - DNA, 575 bp, Homo sapiens
  misc_feature: GYAE6OF01A4URV.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgaggaaacgcccctaagctcctagatctatggtgcatccatttgactaaaggtcgggtacccagtcgaaggttcagcggcagtggatcgtagggacagtactttccactctacacctatcagcacgccctaacacgtcctagaacgtatttagactaactttattactagtaccaactagtactttaaagtaacgttaccgcgtaccttacgtaccgtttccgggacgggtacgggtacccgtaaggggtcggaacgtaataccgtaaaacgtacgtcggtacggccgttacgacctaccgtagttccgttacg

SEQ ID NO: 18872 - DNA, 600 bp, Homo sapiens
  misc_feature: GYAE6OF01BXO0P.4.10.A10.1.454.CMB.1.raw
  modified_base (272)..(272): a, c, t, g, unknown or other
  misc_feature (272)..(272): n is a, c, g, or t
  modified_base (591)..(591): a, c, t, g, unknown or other
  misc_feature (591)..(591): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcgagggctattttcagttattagcctggtatcagacaaaaaccgagggaaacncccctaagcctcctgatctagtggtgctactcctactttgacgtaaaggtccggggtacccctagtaccgtaaggttcgacggccgggactaggtggatcgtggggactagtactttcacttctacaccatcagcacgccctacacgacctagaacgttattttcgacttaactttattacctgtaccaactagtactttaaataacgttaccgcgtaccttacgtaccgtttcgggacgggtaacgggtacccgtaaaggggtcggaagtactaacgaaaacggtacgttggtacggtaccttacggacccaaccgtnttccgttcg

SEQ ID NO: 18873 - DNA, 586 bp, Homo sapiens
  misc_feature: GYAE6OF01AEMMQ.4.10.A10.1.454.CMB.1.raw
  modified_base (268)..(268): a, c, t, g, unknown or other
  misc_feature (268)..(268): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaccgaggaacncccctaagcctctgatctatggtgcactcctactttgacgtaaggtcggggtcccagtcgtaaggttcgaggcggacgtaggtggatcgtagggactagtactttccactctacacctatcagcacgccctacacgtccgtaggaagttacttttacgacttaactttacttactacgtaccaactacgttaactttaataacgttaccgacgttacttaccgttaccggttcgggacgggtaacgggaccgtaagggtacggaacgtacgtaacgtaaaccgtacgtggtacgtcgtacgaccaccgtgtccgttcg

SEQ ID NO: 18874 - DNA, 668 bp, Homo sapiens
  misc_feature: GYAE6OF01CRFHP.4.10.A10.1.454.CMB.1.raw
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
tcagagcactgtagcacgaccggtgctcgatttagcgtcgatctcgaggggggagtcagtcccagtcaggacacagcatggacatgagggtccccgctcagctccgtgggctcctgctgctctggctcccaggtgccagatgtgccatccagttgacccagtctccatccctccctgtctgcatctataggagacagagtcaccatcacgttcgccgggccagtcgagggctatttctagtttattagcctggtatcgaagaacaaaaccgaggaaacnccctaagcctccgtnatctagtggtgctactcctagtttgacgtaaggtcgggtacccagtacgtacggttcgacggtcggactaggtaggtacgtcggtaggggaactaaggtacttttaccgaccttcctaccacctacgtacgaacgaccgtacgaccccttaacgacgtaaccgttaggtaacgttacgtttttacgacctttaaacgtttacttaccgttacgtaacctaacgtaagttaactttaaacttaacgttaccggtaccgtacttaccgttaccggtttcgggacgggtaaacgggaccgtaagggttaggaacgtaagtaaccgtaaaacggtacgttggtacgggtcccttagaccccgttaactcgttcgttcg

SEQ ID NO: 18875 - DNA, 522 bp, Homo sapiens
  misc_feature: GYAE6OF01EMCMV.4.10.A10.1.454.CMB.1.raw
  modified_base (371)..(371): a, c, t, g, unknown or other
  misc_feature (371)..(371): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgcccctaagctcctgatctatggtgcatcctactttgcaaagtgggtccatcaaggttcagcggcagtggatcgtgggacagtatttcactctacaccatcancacgtccctacacgtcctagaagtacgttttcgactaacttattactgtacaacagtacttaataacttacgcgtactcgtacgtttcggacggacggacctaagggtggacgtatacgaaacgaagtgtagtctacgacacctgtctacg

SEQ ID NO: 18876 - DNA, 707 bp, Homo sapiens
  misc_feature: GYAE6OF01C88X5.4.10.A10.1.454.CMB.1.raw
  modified_base (266)..(266): a, c, t, g, unknown or other
  misc_feature (266)..(266): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttaacccagtcctccatcctccctgtctgcatctataggagacagagtcaccatcactgccggcagtcaggctatttcagttattagcctggtatacagacaaaaccgagggaacncccctaagcctccgtagacttcgtagtggtcgactacgtcctacgtttagacgtaaacgggtccggggtaccctagtacgtaaggtttcgaggtccgggtacgtaggttacgggtacttccgggtaggggtaacctaggttaccttttaccgaccttacctacccgtaacctagtaccgacggtacctaacggtaccctaacggtacgtaccttaggaaacgtttacttttacggaacctttaaactttactttaacgtaccgttaacaaacgtaacgtttaactttaaacttacgtttaccgccttaccttaccggttaccggtttcggggaccggtaacggggtaccgtaaaggggttgaacgttaaaccgtaaccgaaaacggtaacgttcgggtaacgttcgtaccgtacctaccgttagttcccgttagttacccc

SEQ ID NO: 18877 - DNA, 566 bp, Homo sapiens
  misc_feature: GYAE6OF01A9ANF.4.10.A10.1.454.CMB.1.raw
  modified_base (191)..(191): a, c, t, g, unknown or other
  misc_feature (191)..(191): n is a, c, g, or t
  modified_base (438)..(438): a, c, t, g, unknown or other
  misc_feature (438)..(438): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgaccccagtctccatcctccctgtctgcatctatagganacagagtcaccatcacttgccgggccagtcagggctattttcagttattagcctggtatcagacaaaaaccagggaaacgcccctaagctcctgatctatggtgcatcctactttgactaaaggtcggggtcccagtcgaaggttcaggcggcagtggatcgtgggacagtatttcactctcaccatcagcagccctaacgagtccctaggaacgttattttagaccttaaacgtttatttaacgtntaccaaactacgtaacctttaaataaacgtttaccgcgtccttactaccgtttcgggacgggaagggtacctaagggtggaagatacggaaaacgtactggtacggtctaggacccaccgtatcgtcg

SEQ ID NO: 18878 - DNA, 728 bp, Homo sapiens
  misc_feature: GYAE6OF01A6TF8.4.10.A10.1.454.CMB.1.raw
tcagagcactgtagcacgaccggtgctcgatttagcgtcgatctcagggggagtcagtcccagtcaggacacagcatggacatgacgggtccccgctcagctccgtggggctcctgctgctctggctcccaggtgccagatgtgccatccagttcgacccagtctccatccctccctgtctgcatctagtaggagacagagtcaccatcacgttcggccggccagtcgagggtctattttcgagtttattacgcctaggtatcgaacgaacaaaaaccgaggaaccacccctaagcctaccgtagactcgtagtggtcactactcctactttgacgtaaggtcgggtacctagtacgaacggttcacggtcggactaggtcggtacgtcggtagggaactaggttacttaccgacttacctaccaacctagtaccgacgaccgtaaccgtaccctaacgacgtacccgtaaggtaacgttacgttttacgaacctttaaactttacgttaaccgtacgtaacctaaacgtaacgttaaactttaaaccgtaaacgtttaaccgccgttaacccgttacgttacccgggtttacggggaacccggggttaaacgggtacccggttaaaggggtacgggaaacgtaacgttaaacccggtaaaaccggttaacgttacgggtacgggtaccgttacggtaaccctacccgttacgtttccggttaacccg

SEQ ID NO: 18879 - DNA, 579 bp, Homo sapiens
  misc_feature: GYAE6OF01B2NNE.4.10.A10.1.454.CMB.1.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (538)..(538): a, c, t, g, unknown or other
  misc_feature (538)..(538): n is a, c, g, or t
  modified_base (570)..(570): a, c, t, g, unknown or other
  misc_feature (570)..(570): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatggtgccgatccagttcgacccagtctccatcctcctgtctgcatctatagganacagagtcaccatcacttcggccgggccagtcgaggctattttcagttattagctgtatcagacaaaacgaggtaaacncccaagctacctgactctagtggtcactatcctagtttgacgtaaggtcgggtaccaatcgaaggttcgaggcggacaggtgaactcgtagggtactagttactttaccgacttctacacctatcgacgacacgtcctaacgacgtaccgtagtaagtagttttacgactttaacttacttaactacgtaacctaagtagtaacttaaattacttaccggactctaccgtacgttcgggacggacgggtaccgtaaggtagacgtanaacgtaaacgacgttggacgtcacgtcacgtnttcgttacg

SEQ ID NO: 18880 - DNA, 594 bp, Homo sapiens
  misc_feature: GYAE6OF01A3DCX.4.10.A10.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgcccgggcagtcgagggctattttcagtttattagcctggtatcaagacaaaaaccgaggaaacncccctaagcctctagatctatggtncatcctactttgacgtaaggtcgggtaccagtacgaaggttcgaggcggacgaggtggactcggtagggactagtactttcacttctaccaccatcagactacgaccctacgacgtccgtagtaacgttattttacgaccttaactttatacgttagtaacctaactacgttaactttaaacgtaacgttaccgcgtaccttacgtacgtttcgggacgggtaacgggaccgtaagggtggaacgtagtaaccgaaacggtacgtggtacgtacgtcgacctacgtcttcgtacg

SEQ ID NO: 18881 - DNA, 645 bp, Homo sapiens
  misc_feature: GYAE6OF01DNJ64.4.10.A10.1.454.CMB.1.raw
  modified_base (193)..(193): a, c, t, g, unknown or other
  misc_feature (193)..(193): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtcctccatccctccctgtctgcatctatagganacagagtccaccatcacgttcggccgggccagtcagggcttatttcagtttattacgcctggtatcaagacaaaacgaggaacncccctaagcctcctagactctagtggtnactactcctagtttcgacgtaaggtcgggtaccagtacgtaaggtcaggcgacgtaggtacgacgtcgtagggtactagtactttcgacctctacacctatacacgtcacgtacctaacgacgtaccgtagtaacgttacttttacgaaccttaaactttacttaccgtagttaacctaaacgtaacgtttaactttaaacgtacgttaacccgcttaccgttaacgttaccggtttaacgggaccgggtaacggtaaccggtaagggtacggtaaacgtacgttaaacgaaacggtacgttcggacgtacgttacgacccttacgtacttcgttaccgg

SEQ ID NO: 18882 - DNA, 993 bp, Homo sapiens
  misc_feature: GYAE6OF01AYKO6.4.10.A10.1.454.CMB.1.raw
tcagagcactgtagcacgaccggtgctcgatttagcgtcgatctcagggggagtcagtcccagtcaggacacagcatggacatggacgggtccccgctcagctccgtggggctcctgctgctctcggcctcccgagggtcgcccgagtagttcggtccgacctaccttaccgtaggttacccgaacccgtacgttccctaccctacccttcccccgttcccgttcgttctacgaccttacgttaccgttaaggtaacggaaccgaacgaacggttaccgtacccaacctacttaccttaccgttcccggggccccggacgtacggtacgggacggttacttttacgttttacgttacgttttacgttccgtaccggtttagtacctaacgaaaccgaaaaacccggaaaaaccggggaacggaaccccgtaacccgtaaccgtcccttacgtacgtacttacgtaggtcggtactaccttaccgttaccttacgtaacgaacgggttaacgggtcccggtacctacgtaaccggttaacggtaccggacgggtaccgaaggtacgggtcgtaacggttccgggtaacgaaccggttatttacccgttacctacccttaccgaacccctaattccggaacccggacgtaacccggtacccgttaacccgtaaaccggcccgtttaaacggtaaagtttaaccgggtttttaacttacccgtaaaaccgtttttaacttttaacccgtttacgttaacgtaaacccctaaagtttacccgtttttaaaactttaaaccggttaaacccgttccggttaccttaccttacggggttttaccccgggtacgggggaaacggggtaaccgttaaccgggggtaaagggttacccgtaaacggtaaacccgttaaaacgggtaaaccccggttagttcgggggtacccgttaaccgtaaccccggtaaccctttaccgttgggttttcccttaacccgg

SEQ ID NO: 18883 - DNA, 650 bp, Homo sapiens
  misc_feature: GYAE6OF01DYW04.4.10.A10.1.454.CMB.1.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccgaggtgccagatgtgccatccagttgacccagtctccatcctcctgtctgcatctagtagganacagagtcacatcacttcgccggcagtcaggtctatttcagttattagcctggtatcaagacaaaacgaggaaancccctaagctcctgatctagtggtcgctactcctactttcgacgtaaaggtcgggtacccagttaccgaaggttcacggtccggacgtaggtggaacgttccggtaggggacctacggtactttccgaaccttctaccgaaccgtactacgaacgcctaacggtaccccgtaacgacgtaccgtagttaacgttactttttacggaccttaaacgtttagttaacttacggttaactaaacgtacgttaacctttaaagttaaccgttaccggtccgtaccgttacgtaccggttttcgggaacgggttacggaaacccgtaagggtacgtaacgtaagtacgtaaacgtacgtggacgtctacggactaacgtgtccgttacg

SEQ ID NO: 18884 - DNA, 668 bp, Homo sapiens
  misc_feature: GYAE6OF01DX35R.4.10.A10.1.454.CMB.1.raw
  modified_base (191)..(191): a, c, t, g, unknown or other
  misc_feature (191)..(191): n is a, c, g, or t
  modified_base (437)..(437): a, c, t, g, unknown or other
  misc_feature (437)..(437): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatccacttcggcccgggccaggtcgaggggctattttctagtttatttagccttggtatcaagaccaaaaaccgaggaaacgcccctaagcctacctgatctagtggtgctactcctactttgacgtaaaggtcggggtacccagtacgtaaggttcgaggcggactaggtggtaatcggtaggggactaggtactttccaccttctaccacctatccgaagcacgtaccctaanacgtactagtaacgttattttacgacttaaacgttactttactagtacctaacgtacgttaactttaaagttaacgttaccgtccgttacgttaccgttaccggtttaccggggaaccgggtaacggggtaaacccgtaaggggttaacggtaaccggtaaacgttaacgaaaacccggtaacgttacgggtacgggtacttacgggaccctaaccctacgttcgttaccg

SEQ ID NO: 18885 - DNA, 675 bp, Homo sapiens
  misc_feature: GYAE6OF01C2KQN.4.10.A10.1.454.CMB.1.raw
  modified_base (273)..(273): a, c, t, g, unknown or other
  misc_feature (273)..(273): n is a, c, g, or t
tcagagcactgtagcacgaccggtgctcgatttagcgtcgatctcagggggagtcagtcccagtcaggacacagcatggacatgagggtcccccgctcagctcctggggctcctgctgctctggctcccgaggtgccagatgtgccatccagttcgacccagtctccatccctccctgtctgcatctataggagacagagtcaccatcactcgccggccagtcgaggctatttcagttattacgcctggtatacagaacaaaacgaggaaacnccctaagctacctgactctagtggtgctactcctacgtttcgacgtaacggtcgggtaccctagtacgtaacggttcacgggtcggactagggtaggtatcggtagggactaggtacttcacctctacacctatcagcacgacctacgacgtccgtagtaagttacgttttacgaaccttaaacttttactttaaccgtacgtaaccgtaaacgttaacgttaaactttaaacgttaaccgttaccgaccgttacctttaaccggttaccggttttaccggggaaccgggtaacggggtaaacccggttaaaggggtaccgggtaaacggtaacgtaaacccggtaaaaacggaccgttacgggacggtcgtaaccgaccgtaacgtacgtttcgttacccg

SEQ ID NO: 18886 - DNA, 567 bp, Homo sapiens
  misc_feature: GYAE6OF01BXY14.4.10.A10.1.454.CMB.1.raw
  modified_base (296)..(296): a, c, t, g, unknown or other
  misc_feature (296)..(296): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgagggaaacgcccctaagcctcctgatctatggtncatcctactttgactaaaggtcgggtacccagtacgaaggttcaggcggcaggtggatcgtagggacagtacttcactctacaccatcagcacgaccctacacgtcctagaattagttttacgacttaactttattactagtacaactagtacttaaataacttacgctacttacgtaccgtttcgggacgggtaacgggtaaccaagggtcggaagtaacgtaaccgaaacggtacgtggtacggacttacgaccacctagttccgtacg

SEQ ID NO: 18887 - DNA, 568 bp, Homo sapiens
  misc_feature: GYAE6OF01BN2EQ.4.10.A10.1.454.CMB.1.raw
  modified_base (272)..(272): a, c, t, g, unknown or other
  misc_feature (272)..(272): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggtctattttcagttattagcctggtatcagacaaaaccgaggaaacnccctaagctcctgactctagtggtcgctactcctactttagacgtaaaggtcggggtacccagtcgaaggttcaggtcggctaggtggactcgtagggactagtacttcactctacacatcagcacgacctacacgcctagtaactattttacgactaatttactacttatacaactagtacttaaataacgttacgacttccttactacggtttcgggacggtaacgggtaccgaagggtacggaatacgtaacgaaaacgtacgttaggacgtctagaccacgtatcggttacc

SEQ ID NO: 18888 - DNA, 629 bp, Homo sapiens
  misc_feature: GYAE6OF01BKJ2B.4.10.A10.1.454.CMB.1.raw
  modified_base (96)..(96): a, c, t, g, unknown or other
  misc_feature (96)..(96): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagagcactgtagcacgaccggtgctcgatttagcgtcgatctcgagggggagtcagtcccagtcaggacacagcatggacatgagggtccccgntcagctccgtggggctcctgctgctctggctcccaggtgccagatgtcgccatccagttcgacccagtctccatccctccctgtctgctatctagtaggagacagagtcaccatcctacgttcggccggcaggtccgaggtctagttttcagtttattacgcgtagtatcaagtaacaaaaccgaggaaacctccctaagccttaccngtactcgtagtcggtcactactccgtagttcgacgtaaacggtcggtaccagtacgtaagtcgaggcgactaggtgatcgtaggactagttacttcacttcacacatacngactacactagcgtactagtacgttnttanactaactttatacgtataaccgtaatacgttaactttaaacgtacgttaccgtacttccgttaaccgtacggttaaccggggacggtaacgggaaccgggtaagggtacgtaaacgtaccgtaaaccgaaacggttacgtacgggtaccggtacgttaccaacctccgtttaacgcgtttaaccg

SEQ ID NO: 18889 - DNA, 726 bp, Homo sapiens
  misc_feature: GYAE6OF01AI076.4.10.A10.1.454.CMB.1.raw
  modified_base (715)..(715): a, c, t, g, unknown or other
  misc_feature (715)..(715): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgaccccagtcctccatccctccctgtctgcatctataggagacagagtcaccatcacttgccgggcagtcagggctattttcagttattagcctggtatcagacaaaaccgagggaaacgcccctaagcctacctgacttctatggtgcagtcctactttgacgtaaaggtcggggtaccctagttacgtaaacggtttcgaacggtccgggaccgtagggttcgggaaacgttccgggtaacgggggtaacctaacgggttaacttttacccggtaaaccctttccctaacccgtacccctaagttacccgtaaccggacccgtaaccgggacccctttaacggaaccggtacccgttaacgggtaaacgtttacgttttttacggaccctttaaaacttttaacgttttaaccgttacggttaacctaaacgtacgttaactttaaaacgttaacgtttaaccgccgttacttacgttaccgttaccgggacggtaccgggaaccgtagggtacgggacgtacgtaacggaaacgtacgtggtacgcgttacgactaccngttcgttaccg

SEQ ID NO: 18890 - DNA, 660 bp, Homo sapiens
  misc_feature: GYAE6OF01CFHV7.4.10.A10.1.454.CMB.1.raw
  modified_base (276)..(276): a, c, t, g, unknown or other
  misc_feature (276)..(276): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtcctccatccctccctgtctgcatctataggagacagagtcacatcacttgccgggccagtcgagggctatttctagttattacgcctggtatcaagaacaaaaaccgaggaaacnccctagctctgactctagtgtgctatcctactttgacgtaaaggtccgggtaccagtaccgtaaggttacgaacggtcggacgtaggtggaacgtcggtagggactaggtactttccgaaccttccgtaccaacctacgtaccgacgtacgaacgtaccccttaacgaccgtaccgttaggtaaacgttagttttcgaaccttaaacgtttaactttacctaacgttaaccgtaacttaacgttaactttaaacgttaacgttaccggtaccttaccgttaccgttacggttaccgggacgggtaaccgggtaaccgtaaggggtacggtaacgtaagtaacgaacggtacgtgtacggtctacgacctactacgttcgttacg

SEQ ID NO: 18891 - DNA, 554 bp, Homo sapiens
  misc_feature: GYAE6OF01DN9UA.4.10.A10.1.454.CMB.1.raw
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcgccgggccagtcagggctatttcagttatttagctggtatcagacaaaacgaggaaacgcccctaagctcctanatctagtggtgctatccactttgacgtaaagtcgggtacccatccgaaggttcaggcggcagtggatcgtagggactagtactttcactctcacatccgagctacgccctanacgtcctagaacgttntttagactaacgttattactgtacaangttacttaaataacgttaccgcgtacctacgtacgtttcgggacggtaacgggaaccgtaagggtcgaagtaactacgaaacgtactggtacgcgtacgacaccctatccgtacg

SEQ ID NO: 18892 - DNA, 707 bp, Homo sapiens
  misc_feature: GYAE6OF01BRPKJ.4.10.A10.1.454.CMB.1.raw
tcagagcactgtagcacgaccggtgctcgatttagcgtcgatctcagggggagtcagtcccagtcaggacacagcatggacatgagggtccccgctcagctccgtggggctcctgctgctctggctcccaggtgccagatgtgccatccagttcgacccagtctccactccctccctgtctgctatctataggagacagagtcaccatcctacgttcggcccgggcagtcgagggtctattttcagtttattagccgtggtatcaagaaccaaaaaccgagggaaacgacccctaagcctacctagacttctagtggtcgacctactccttagtttacgaccgtaaacggttcgggtacccagttaccggtaaggttccgaggcggtactaggtacggtacgtcgtagggaactacgttactttccgaaccttccgtacctaacctacgtcaacggtaccaaccggtccctaacgacggtacctaacggtaagtttaagttttcgaaactttaacgtttaacttacgtacgtaactaacgttattaacctttaaagttaacgttaccgaccgtacttacccgtacgggtttcgggaaccgggtaacggaccggttaaagggtacgggtaaacttaccgaaacggtaaaccggtacgttccgggtaacggtaccctacggaaccctaacgttaccgttcgtttaccgg

SEQ ID NO: 18893 - DNA, 719 bp, Homo sapiens
  misc_feature: GYAE6OF01DOUCU.4.10.A10.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
tcagagcactgtagcacgaccggtgctcgatttagcgtcgatctcgagggggagtcagtcccagtcaggacacagcatggacatgagggtccccgctcagctccgtggggctcctgctgctctggctcccaggtcgccagatgtgccatccagttcgacccagtcctccactccctccctgtctgcatctagtagganacagacgtcaccatcacgttcgccgggccagtcgaggctattttcagttatttagccgtaggtactcgaagaaccaaaaacgaggaaacgcccctaaagcctaccngtactcgtagtggtacactactcctagtttcgacgtaaacgggttcgggaccctagttaccggtaaaggttcgaacgggcggacagggttacggtactacggttaggggaacctaggttaactttaccacctttaccgacctaactacgttaccgaggacctaccggtaccctaacggacgtaccgtaaggttaaacttacgttttacgaacttaaactttacttaacgtacgtaccaaacgttagttaacttaaacgttacgttaaccgtccgttacgttaccgttaacgggttccggggaacgggtaaaccgggtaacgtaaacgggttacggggaaacctaacgtaaaccgaaaaccggttacgttacgggtaccggtactaccggtaaccacggttaaccttccgttaccg

SEQ ID NO: 18894 - DNA, 705 bp, Homo sapiens
  misc_feature: GYAE6OF01D74JA.4.10.A10.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagtttatttagcctggtatcaagacaaaaaccgagggaaacncccctaagcctcctgatctagtggtnctactcctactttgacgtaaaggttcggggtaccctaagttaccgaaacggtttcgaacggtccgggacgtaggttagggaacttcggtacgggggaacctaggttaacttttccgaaccttcctaccaccctaacttccaacggtcaacggtaccctaacgacgtacccgttaaggtaaagtttactttttacgaacctttaaacttttactttaaccgttacggttaaccctaaacgtaacgttaacctttaaaattaaacgtttacccgtaccggtctttaccgtaccggttttaccggggaccgggtaaacggggtacccgtaaaggggttcgggaaacgtacgtaaaccgaaacggtaacgttgggtacgtaccgtacgacctaaccgtattccgttacg

SEQ ID NO: 18895 - DNA, 613 bp, Homo sapiens
  misc_feature: GYAE6OF01DFVRK.4.10.A10.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (591)..(591): a, c, t, g, unknown or other
  misc_feature (591)..(591): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatccctccctgtctgcatctataggagacagagtcaccatcacgttcgccgggccagtcagggtctatttcagttattagcctggtatcagacaaaacgagggaancccctaagctctgatctagtggtnctactcctactttgacgtaaaggtcgggtacccagtaccgtaaggttcgagtcggactaggtcggatcggtagggactagtacgtttacacttactccactactcgaacgtcaacgtaccctacgacgtccgtaagtaacgttattttacgacttaaactttacttaacgtcgttaaccgaactagttaactttaaattaccgtacggtctacttaccgtaccggtttacgggaccgggtaagggtacccgaaggggttacggaagtaaccgttacgaaaacggtacgttggacggtntaccgacctaactgtcgtaccg

SEQ ID NO: 18896 - DNA, 538 bp, Homo sapiens
  misc_feature: GYAE6OF01A97QN.4.10.A10.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (429)..(429): a, c, t, g, unknown or other
  misc_feature (429)..(429): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggcagtcagggctattttcagttattagccttggtatcagacaaaaaccgagggaaacnccctaagctctgatctgtggtncatcctatttgactaaaggtcgggtacccatcgaaggtcagcggcaggtggatcgtagggacagtactttcactctacaccatacagcacgccctaacacgtcctagaagttacttttcgacttaacttattactntaacaactagtacttaataattaccgactctactacgttcgggcggtacggtaccgtaagggtcgaagtactacgaaacgactggtacgtctagaccactgtcgttacg

SEQ ID NO: 18897 - DNA, 600 bp, Homo sapiens
  misc_feature: GYAE6OF01CINX3.4.10.A10.1.454.CMB.1.raw
  modified_base (273)..(273): a, c, t, g, unknown or other
  misc_feature (273)..(273): n is a, c, g, or t
  modified_base (435)..(435): a, c, t, g, unknown or other
  misc_feature (435)..(435): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcaagacaaaaaccgagggaaacncccctaagctcctgatctagtggtgcatcctatttcgactaaaggtcggggtacccatacgaaggttcaaggtcggacgtaggtggatcgtgggacagtacttcactctcactatcagcacgcctacacgcctagaagtatttgacctaactttattacgtntaccaacgtgtaactttaaactaagtttccgacgtccttacgtaccggttttccgggaccgggaacggggtaacccgtaaaggggttcgggaacgtacgttaaaccggaaaacggtaaccgttgggtcggtacttacggaacccttaccgtaagttccgtttacg

SEQ ID NO: 18898 - DNA, 618 bp, Homo sapiens
  misc_feature: GYAE6OF01BT95A.4.10.A10.1.454.CMB.1.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctccatccctccctgtctgcatctataggagacagagtcaccatcacttgctgggccagtcagggctattttcagtttatttacgcctggtactcgaagaccaaaaaccgaggggaaacncccctaagcctcctgatctagtgggtnctactcctagtttgacgtaaaggtcgggtacccagtacgaaggttcgaggcggcgaggtggatcgtaggactagtactttccacttctaccactatcgacgcacgtccgtacacgtcctagtaacgttntttacgaccttaagtttacttacgtacgtacaacgtaacgttaactttaaataacgtttaccgcttactaccgttaccggtttacggggaccgggtacgggtaaccgtaaggggtacgtaacggaactacccggaaaaacggtcgttacgggtcggtaccgtagaccctaacgtacgttcg

SEQ ID NO: 18899 - DNA, 704 bp, Homo sapiens
  misc_feature: GYAE6OF01BSBDM.4.10.A10.1.454.CMB.1.raw
  modified_base (277)..(277): a, c, t, g, unknown or other
  misc_feature (277)..(277): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatctacttgccgggcagtcagggtctattttcagtttattagcctaggtatcgaagaacaaaaaccgagggaaacncccctaagctccgtgatctatggtgactatcctatttgacgtaaacggtcgggtacccagtaccgaaggttcgaacggcggacgtaggtacggtaacgttcggtagggaacctaggttaactttacccgacgtttaccgtaccaaccctacgtaccgaacgcctaacggtccctaaaccgtacgtacccttaaggtaaacgttatttttaacccggaacctttaaaccggttttacttaacccgttaggttaaccctaaacgtaacgtttaaccgtttaaaactaaccgtttaccggaccgttacccttacgtacccgttttaccggggacggttaacgggaaacccgtaaaggggttcggaaacgtaacgttaccgtaaaaggtacccgttagggaccgtacgtacggaccaaccgtgttccgtcg

SEQ ID NO: 18900 - DNA, 574 bp, Homo sapiens
  misc_feature: GYAE6OF01D5WVL.4.10.A10.1.454.CMB.1.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (379)..(379): a, c, t, g, unknown or other
  misc_feature (379)..(379): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggcattttcagttatttagcctggtatcagacaaaaacaggaaacncccctaagctcctgatctatggtncatccactttgactaaaggtcgggtccatacaaggtcagcggcagtcgatcgtgggacagtatttcactctacacatcagcagcctangcctagaactattttagacttaacttattacttgtacaactagtaactttaataaactttacgcgtacttacctaccgttttcgggaccgggtaacgggaaacccgtaaggggtagggtaaacgtaagttaaccgaaaaacggttaacccgttaggacgggtacgtacggaccaaccccgttattcccggtttac

SEQ ID NO: 18901 - DNA, 570 bp, Homo sapiens
  misc_feature: GYAE6OF01BCIA0.4.10.A10.1.454.CMB.1.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
  modified_base (448)..(448): a, c, t, g, unknown or other
  misc_feature (448)..(448): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgaccagtctccatccctcctgtctgcatctatagganacagagtcaccatcacgttcgccgggccagtcgagggtctattttcagttattagccttggtatcgaagaacaaaaacgagggaaacncccctaagcctaccgtagtactcgtagtcggtgactactcctagtttcgacgtaaaggtcgggtaccctagtacgtaaaggtcaggcgacgaggtgatcggagggactagtacttcacttcacacctatacagccacgcctaacagtctagagttattacgactaacttntactgtacaagtactacttaatacttacgcgtactcgtacgttcgggacggtaacggaccgaaggtcggaataacgtaacgaaaccggtagtcggtacgtctacgaacctactgttcgttcg

SEQ ID NO: 18902 - DNA, 747 bp, Homo sapiens
  misc_feature: GYAE6OF01EWLMA.4.10.A10.1.454.CMB.1.raw
  modified_base (95)..(95): a, c, t, g, unknown or other
  misc_feature (95)..(95): n is a, c, g, or t
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
tcagagcactgtagcacgaccggtgctcgatttagcgtcgatctcagggggagtcagtcccagtcaggacacagcatggacatgagggtccccgntcagctcctggggctcctgctgctctggctcccaggtgccagatgtgccatccagttcgacccagtctccatccctcctgtctgcatctagtagganacagagtcaccatcacttcggccgggcagtcgaggctattttcagtttattagcctggtactacaacgaacaaaaaccgagggaaacnccccgtaaagtcctacctagacttacgtagtggtagacactcctaacgtttcggacgtaaagggttccggggtaccctaagtaccgtaaacgggttcgaaggtccgggacgtaagggtcgggtaactcggtaacgggtaacgtagttaacgttttacctaacctttccgtaacctaaccctaacgtttaccgaacgtaccgtaaccgtaccccgtaaacgtacggtacccgttaaggtaaacgtttacgttttaaccgaaccgtttaaaccttttacgtttaaccttacgttaaccaaacgttacgttaacctttaaaacgttaacgttaccgtacgttaccttaacgtaaccggtttaccggggaccgggtaacgggtaacccggtaagggttacgggaacgtaacgtaacccgtaaacggtacgttgggaaccggtactcggaacctacgttacgtccgtttacg

SEQ ID NO: 18903 - DNA, 722 bp, Homo sapiens
  misc_feature: GYAE6OF01E4B0B.4.10.A10.1.454.CMB.1.raw
  modified_base (195)..(195): a, c, t, g, unknown or other
  misc_feature (195)..(195): n is a, c, g, or t
tcagagcactgtagcacgaccggtgctcgatttagcgtcgatctcagggggagtcagtcccagtcaggacacagcatggacatgagggtcccccgctcagctcctggggctcctgctgctctggctcccaggtgccagatgtgccatccagttcgacccagtcctccatccctccctgtctgcatctagtagganacagagtccaccatctacgttcggcccgggccagtcgagggtctattttcgagttattagcctggtactcgaagaccaaaaaccgagggaaacgcccctaagcctacctgactctagtggtcgactacttcccgtaactttcggaacgtaaaggtcgggtacccctaattaccgtaacggttcgaagggccggtacgtaggtacggtacgtcgtagggaacctagttactttccaaccttccgtacccaccactaccgacgtaccacgtaccctacgtacgtaccgtaagtaacgttacgttttacgtaccttaaactttaacgttacgtacgttaacctaaacgttaacgttaacctttaaacgttaacgttaaccgtacccgttaccgttaccgttaacccggttttacgggaaccggggttaaccggggtaaaccgtaaggggttacggtaacggtaactaaaccggaaaacggtacggttacggacggtaccgtaccgtaccctaccgtattaccgtttaccg

SEQ ID NO: 18904 - DNA, 771 bp, Homo sapiens
  misc_feature: GYAE6OF01DKQKN.4.10.A10.1.454.CMB.1.raw
  modified_base (96)..(96): a, c, t, g, unknown or other
  misc_feature (96)..(96): n is a, c, g, or t
  modified_base (756)..(756): a, c, t, g, unknown or other
  misc_feature (756)..(756): n is a, c, g, or t
tcagagcactgtagcacgaccggtgctcgatttagcgtcgatctcgagggggagtcagtcccagtcaggacacagcatggacatgacgggtccccnctcagctccgtggggctcctgctgctctggcctcccgaggtcgccagatgtcgccatcccagttacgaccctagttcctccactccctcccgtgtctcgcctatcgtagaggacgacagatccacactctacgttcggccggacctaggtacgagggtcttaatttctaggttttaattacggtccgttaggtactacgaacgaaaccgaaaaaccggacggtaaaccgtacccctaagtcctacgtcgactttcgtagtcggtcactactaccttagttacgacgtaacggtcggtacctagtacgtagtcgagtcggacgtagtaggactcggtacggtactaggttctaaccgttcctctaccaaccgtactacgtccgactacccggtataaaccggcgtaccgtaaggtaacgttttagttttacctaaacttacgttttaacctttcgaagtaacccgtaaactacgggttaaacccttacccttaacccgttcccccgaacgtttacccgttaccgggtttacccgggttaaccgggggaccggtttaaaacggggaaaccgtttacggggtaaacgttaaccccgtaaaggttaaccggaaaacccggttggttacgggacccgttaagtaccccggacttaacccgggttntttaacccgggtccc

SEQ ID NO: 18905 - DNA, 597 bp, Homo sapiens
  misc_feature: GYAE6OF01EWLWA.4.10.A10.1.454.CMB.1.raw
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (556)..(556): a, c, t, g, unknown or other
  misc_feature (556)..(556): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccagggaaacnccctaagctccngatctatggtcgcatcctactttgactaaaggtcgggtacccagtctaaaggttcaaggcggacaggtggatcgtaggggactaggtactttcgacttctacgtaccagttaccaaggtccacgtaccctaaccgacggtcctaaggtaacgttactttttagacttaaacttttaagtttaaccttacgttaaccaaacgtacgtacttaaacgttaacttacgacgtcttactacgtttcggacggtagggaaccctaagggtcgaagtanacgaaacggtacgtgtacggtctacgacacctgtcgttacg

SEQ ID NO: 18906 - DNA, 698 bp, Homo sapiens
  misc_feature: GYAE6OF01B87SL.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctccatccctccctgtctgcatctataggagacagagtcaccatcacttcgccgggccagtcgagggtctattttcagtttatttacgccttggtatcgaacgaacaaaaaccgagggaaacgcccctaagcctccgtagatcgtagtcggtgctactcctactttgacgtaaacggtcgggtaccctagtaccgtaaggttccgacgggcggtacgtagggtaggacttcggtaggggactagtactttccaccgttcctacaccataccgagccacgaccctaacgacgtaccgtagtaacgttcttttacgaacctttaaaccgtttactttaaccgtacgtaacccgtaaacgttaacgttaaccttttaaaacgttaaacgtttacccggtaccgttacccgttaaccgttaccgggtttcccgggaacggggtaacgggtaaacccggtaaggggttacggaacgtaagtaacccggtaaacggtacggttacggtcggtacctacggaccctacgttacgttccgttacg

SEQ ID NO: 18907 - DNA, 706 bp, Homo sapiens
  misc_feature: GYAE6OF01BH0PG.4.10.A10.1.454.CMB.1.raw
  modified_base (96)..(96): a, c, t, g, unknown or other
  misc_feature (96)..(96): n is a, c, g, or t
tcagagcactgtagcacgaccggtgctcgatttagcgtcgatctcagggggagtcagtcccagtcaggacacagcatggacatggagggtccccgntcagctccgtggggctcctgctgctctggctcccaggtgccagatgtgccatccagttcgaccctagtctccatccctcctgtctgcatctataggagacagacgtcaccatcctacgttcggccgggcagtcgaggtctattttcagttattagctagtatcaagaactaaaaccgagggaaaccgtcccctaaagtcccttaccgtagtacttcgtaagtggtacactactccgtagtttacgacgtaaagggttcgggtaccctaagttacgtaaaggttccgacggccggtatagggtacgacgttcggtagggaactacggttactttacgacttaccgacctaacacttacgacgacgtacgaccctaacgtacgtacctaagggtaaagtttcttttaccgaaactttaactttacgttaacgttacgtaacctaaaccgtaggttaaaccttttaaacgtaacgttaccgggtaccttaccgttaaccgttaccggttacgggggacgggtaaacccggtacgggtaaaggtaggaacgttaactaaccggtaaaacggtcgttgggacgtcgaccgtacctacgttaccgttcggttaccg

SEQ ID NO: 18908 - DNA, 643 bp, Homo sapiens
  misc_feature: GYAE6OF01EWPCX.4.10.A10.1.454.CMB.1.raw
  modified_base (275)..(275): a, c, t, g, unknown or other
  misc_feature (275)..(275): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctagtaggagacagagtcaccatcacttgcccgggccagtcgagggctattttcagtttattagcctggtatcaagacaaaaacgagggaaacncccctaagctcctgactctagtggtcgctactcctatttcgactaaaggtcggggtccctaagtacgtaacggttcaaggcggactaggtggactcggtagggactaggttactttacaccttacctacacctagtccaagcctaacgccctaacgacgtaccgtagtaacgttatttacgaacttaaactttagttactttagtaacctaactagtaacctttaacttaaacgttaccgtcgttacttaccgttaaccggtttcgggaaccggggtacgggtaaaccgaaggggtcggtaacgtaacgttaaccggaaacggtaacgttggtaaccggtactacgaacccgacgttagtcgttaccg

SEQ ID NO: 18909 - DNA, 558 bp, Homo sapiens
  misc_feature: GYAE6OF01B5Q8X.4.10.A10.1.454.CMB.1.raw
  modified_base (193)..(193): a, c, t, g, unknown or other
  misc_feature (193)..(193): n is a, c, g, or t
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (366)..(366): a, c, t, g, unknown or other
  misc_feature (366)..(366): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagagcactgtagcacgaccggtgctcgatttagcgtcgatctcagggggagtcagtcccagtcaggacacagcatggacatgagggtccccgctcagctccgtggggctcctgctgctctggctcccaggtgccagatgtgccatccagttcgacccagtctccatccctccctgtctgcatctatagganacagacgtcaccatcacgttcgcccgggccagtcgagggctattttcgagtttactttacgccttaggtatcaagacaaaaaccgagggaaacncccctaagcctaccgtgtactctagtggtnactataccagtttcgactaaaggtcgggtaccatacgaggttcagcggnaggtgatcgtgggacagtactcactctcacatcagcagcctaanacgtctagaattntttacgactaacttatactntacaacagtacttaaagtacttacgcttactaccgtacgttacgggacggtacggacctaaggggtcgaagtacacgaaaacgtcgtaggtacggactgaccacctgttcgtacg

SEQ ID NO: 18910 - DNA, 745 bp, Homo sapiens
  misc_feature: GYAE6OF01E075N.4.10.A10.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagagcactgtagcacgaccggtgctcgatttagcgtcgatctcgagggggagtcagtcccagtcaggacacagcatggacatgacgggtccccgctcagctccgtggggctcctgctgctctggctcccgaggtgccagatgtcgccatccagttcgacccagtcctccatccctccctgtctgcatctagtagganacagacgtcaaccatcacgtcgccggccagtcgaggtctattttcagttattacgccttggtactacaacgaacaaaaacgaggaaccnccctaagctcctagattctagtggtcactactcctagtttacgacgtaacggtcgggtacctagtaccgtaaggtcgacggcggtacgtaggtacggattcggtagggactacggttactttaccgtactacctaccgtacctagttaccgaacgtaccctaacggtaccccttaagaccggtccttaaaggttaaacgttttcgttttaccggaaaccttttaaacgtttacctttaaacgttaccgtaaacctaaacgtacggtttaaacctttaaagttaaaccgtttacccgacgtttacccttaccggtttaacccgggtttcggggaaaccggggtaacggtaacccgggtaaaaggggttcgaaaaccgttaaccgtaaacggtaaaacccgggtacgttaggggtaacccgtacgtaccgaacccgtttaacctagttttcccgttacg

SEQ ID NO: 18911 - DNA, 765 bp, Homo sapiens
  misc_feature: GYAE6OF01C00JO.4.10.A10.1.454.CMB.1.raw
  modified_base (193)..(193): a, c, t, g, unknown or other
  misc_feature (193)..(193): n is a, c, g, or t
tcagagcactgtagcacgaccggtgctcgatttagcgtcgatctcgagggggagtcagtcccagtcaggacacagcatggacatgagggtccccgctcagctccgtggggctcctgctgctctggctcccaggtgccagatgtgccatccagttgacccagtctccatccctcctgtctgcatctataggganacagagtcacctatccacgtggcccggccaggtcagggtctattttctagtttatttagcctggtactacaacgaacaaaaccgaacgggaaacgtcccctaagcctcctagtactactagtggtcgcacgttcctacgtttcgacgtaaacggtccggggtaccctagtaccgtaacgttacggacggtaccgggacgtaaggttacggtacgtaccggtagggtaacgtacggttaacttttccaccttacccttccaaccctaacttccggaaccgaccgtaaccgtaccctaaaccgtacgtaaccgttagggtaactttacggttttaactaaccctttaaacgttttaactttacggtaacttaaccgttaaactaacgtttaacgtttaaaacgttaaccgtttaccggtaccgttaccttaccggttaccggttaccgggggtacccgggtaaaccggggacccggttaaaggggtacgaacgggttaaccttaaacccgggtaaaacgtaacccggttgggtacggtaccgttacggaaccttacccgtgttccgtttacccg

SEQ ID NO: 18912 - DNA, 777 bp, Homo sapiens
  misc_feature: GYAE6OF01CKQJM.4.10.A10.1.454.CMB.1.raw
  modified_base (131)..(131): a, c, t, g, unknown or other
  misc_feature (131)..(131): n is a, c, g, or t
  modified_base (134)..(134): a, c, t, g, unknown or other
  misc_feature (134)..(134): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (495)..(495): a, c, t, g, unknown or other
  misc_feature (495)..(495): n is a, c, g, or t
tcagagcactgtagcacgaccggtgctcgatttagcgtcgatctcaggggggagtcagtcccagtcaggacacagcatggacatggacgggtcccccgctcagctccgtggggctcctgctgcctgcgccncgngcacgagtgtgtcgactctacgtacgtaccaccgtctcctacctcctccctcgtcgtcgtcactacgttacgtaaggacggacgacggtaacgtactaacctactacctacgttccggtccggggtacccggacgtacggtacgggtacgttacttttacgttaagtttattttacggtccgtacggttagtaacaacggaaaaccgaaaaaccggaaacgggaacggtaccccctagcgttccctagtatacttgtcggtcgtacctaccttaccgtacgtttagaacgtaacgggtcggggtcccaactaggtacggttanaccggggngtacggataggtcgtacgtgggaatacgtnttacctcactacgacactacgtagacctctaccgaaccgtgtaacctaggtaatttacgtttacccgtaattaacctttaaacgtttactacgggtaacctaaaaccgtcgtttaaacgttaacctttaaacgttacccgtgtaccccgttacgtttaacccgggtcggggtaccgggaaaagggtaacggtacgggtaaggtaccgtaaagttaaccaaaaccgggttcggtacggtgttaacccggcgtaaaccctaccggttactgtttccccggttac

SEQ ID NO: 18913 - DNA, 682 bp, Homo sapiens
  misc_feature: GYAE6OF01B6GU1.4.10.A10.1.454.CMB.1.raw
  modified_base (192)..(192): a, c, t, g, unknown or other
  misc_feature (192)..(192): n is a, c, g, or t
  modified_base (673)..(673): a, c, t, g, unknown or other
  misc_feature (673)..(673): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtcctccatccctccctgtctgctatctatagganacagacgtcaccatcacgttcgccggcagcgagggctattttctagttatttagcttaggtataccgagtaaccaaaaaccgagggaaaccgtccccgtaagcctcctgtatctagtggtcacatacctagttcgacgtaaggtcgggtacccagttacgtaacggttacgacggcggctaggtcgggtaacttccggagggtaacgtaacgtttacttactaccgttccttaccgtaaccctactaccgacgtaccaccggtaacccctaacgacgtacccgtttaaggaaaccgtttactttttaacggacctttaaacgtttaacctttacgtacgttaaccgtaactaacgttacgttttaaaataccgttaccgacttaccgttacttaccgggtttgggaccgggtacggaccggaaagggttgaacgtagtaaccgtaaacggtacgttaggaccggttcaccggtacaccgtntcgttaccg

SEQ ID NO: 18914 - DNA, 595 bp, Homo sapiens
  misc_feature: GYAE6OF01CB3J8.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacgttcgccgggccagtcgagggtctattttcagttatttagcctggtatcagacaaaaccgaggaaacgcccctaagctcctgatctagtgtgcatcctactttgacgtaaaggtcggggtacccagtacgaagtattacgaggtcggctaggtggattcgtgggacagtatttacacttcctacgacctatccaggttactacttaaccgaaccgtagaattacgttttagaacctaacgttactaccttagtaccaacgatacgttaaccgaccttacccccgtccgtactcctaccgttcgggacgggaccggtacgtaggtgggaacgtacgtaccaaaacggtcttacggtaggaccgtcgacccacgtacttcgtgtttacccg

SEQ ID NO: 18915 - DNA, 813 bp, Homo sapiens
  misc_feature: GYAE6OF01CUL44.4.10.A10.1.454.CMB.1.raw
  modified_base (203)..(203): a, c, t, g, unknown or other
  misc_feature (203)..(203): n is a, c, g, or t
tcagagcactgtagcacgaccggtgctcgatttagcgtcgatctcgagggggagtcagtcccagtcaggacacagcatggacatggacgggtccccgctcagctccgtgggcctcctgctgctcgtcggcctcccgaggtcgccaggatgtcgccatccagttcgacccagtctccactccctcctgtctgcatctagagganacagactcacatcacgtcggccggcagtcgacggtcttatttacgtagtttacttagaccgttaggttaactccgaaacgaaaccgaaaaaccggtacggggaaaacctcccccgtaaagcccgttaccgtacggtacttacgtaacgttcggtacgactacttaccgtacgttttacggaaccgtaaacggggtccgggttaacccctaggttaaccgtaacgggttaccggaacggtccggacgtaagggttacggtactacggtaacgggactaacggttaactttcccaacgttacccaaccgtaaccctaacgtccgtaacggacccgtaaccgtaccccgttaacgaccggttaacccgtaaggtttaacgtttaaccgttttaccgaaacccgtttaaacttttaccgtttaaccgtacttaaacccgttaaacgtaacgtttaaaccgtttaaagttaaccgttccgaccgttactttaacccggtacgggtttacgggaaccgggtacggtaaacccggtaggttaggaaaccgtaccgttaaacggaaaacggtcgttaggtaccggactacccgtactaaacccgtgtttcccgttacg

SEQ ID NO: 18916 - DNA, 753 bp, Homo sapiens
  misc_feature: GYAE6OF01C81L7.4.10.A10.1.454.CMB.1.raw
  modified_base (277)..(277): a, c, t, g, unknown or other
  misc_feature (277)..(277): n is a, c, g, or t
  modified_base (529)..(529): a, c, t, g, unknown or other
  misc_feature (529)..(529): n is a, c, g, or t
tcagagcactgtagcacgaccggtgctcgatttagcgtcgatctcgagggggagtcagtcccagtcaggacacagcatggacatgacgggtccccgctcagctccgtggggctcctgctgctctggcctcccgaggtcgccaggatgtcgccatccagttcgacccagtcctccactccctccctgtctgctatctagaggagacagactcacatcacgtcggccggaccaggtcgaggtacttattttacgagtttacttacgtccgttaggttanaccgaacgaaacgaaaaaccggacggtaaacccgtaccccgtaaagtcccgttaccgtagtactacgtaagtcggtcactacctaccgttagtttacggaaccgtaaacggggttccgggtaccctaagttaaccggtaaaggttccgaacggggtcgtacggtaaggtcggtaatcggaacgggtaactagttaacctttccgaaccttaccctacctaacctaacgacaccgaccgtaacgacccgtaanaccgtcgtaagtacgttaacgtttacactttaatttacttagtacgtaactaaacgtagtttaacctaaagttaaccgtaccgtaccgttactaccgggttaaccggttccggggaaccgggttaaagggaacccggttaagggaaccggtaagaaacccgtaaccggtaaaacggcggtttaccggacgttaccgacgtacccctaacttacgttcttacccg

SEQ ID NO: 18917 - DNA, 637 bp, Homo sapiens
  misc_feature: GYAE6OF01EI9YK.4.10.A10.1.454.CMB.1.raw
  modified_base (120)..(120): a, c, t, g, unknown or other
  misc_feature (120)..(120): n is a, c, g, or t
  modified_base (277)..(277): a, c, t, g, unknown or other
  misc_feature (277)..(277): n is a, c, g, or t
tcagagcactgtagcacgaccggtgctcgatttagcgtcgatctcagggggagtcagtcccagtcaggacacagcatggacatgagggtccccgctcagctcctggggctcctgctgctntggctcccaggtgccagatgtgccatccagttgacccagtctccatcctccctgtctgcatctataggagacagacgtcaaccatcacgttcgcccggggccagtcgagggtctattttcagttattagcctggtatcagacaaaaacgaggaaacncccctaagcctcctgatctatgctgctactcctaaggtttaacaaaggtcgggtacccagtacgaagtacttcgagtcggacgtaggtaggtatcgtgggaactaggtactttacacgttactaccaacctagtacctaaggttaacgttacctaaacgaacccgttaggtaaacgtttacgttttacgaacttaaaccgtttaactacgttaccgtaactaacgtaagtaacgtttaaccgaacccttccccgtacgtacttaccgtacggttaccggacgggtacggaaccgtaagggtacggacgtactaaccgaaggtaccgtggtacgacgtcgacctaccagttcgtcgttacc

SEQ ID NO: 18918 - DNA, 927 bp, Homo sapiens
  misc_feature: GYAE6OF01DHVNP.4.10.A10.1.454.CMB.1.raw
  modified_base (95)..(95): a, c, t, g, unknown or other
  misc_feature (95)..(95): n is a, c, g, or t
  modified_base (217)..(217): a, c, t, g, unknown or other
  misc_feature (217)..(217): n is a, c, g, or t
tcagagcactgtagcacgaccggtgctcgatttagcgtcgatctcagggggagtcagtcccagtcaggacacagcatggacatgagggtccccgntcagctcctggggcctcctgctgctcgtcggcctcccgaggtcgccagtatgtcgaccacgtcctagttaccgaccctagttcctacctacttcccctccgtgtctcgctatctaagagganacagacgtaccaacctatctacgttcggcccgggcctaggtacgaggtcttacgtttacgtaagtttagttacgtccgtaggtactacgaacgaaacgaaaaaccggacgggaaaccaccccgtacgtcctacgtactactctagtcggtacactactccgtacgttacgaacggtaacggtccgggtactagtacggtaacggttcgacggcggtacgtaggtacggtacgtcggtagggactaagttacttaccgtaccttcccgtaacctactacctaccggtaaccgtaccgtaaccgtaccccttaaacgaccggtttaacccgttaaggtaaaccgttttacgttttaaaccggtaaccctttaaacgtttttaaccgttttaaccgtacccggtttaaaacccctaaaacggtttaacccgtttaaacgtttttaaaaaccgtttaaacccggtttaccgggtaaccccgttaaccccgttttaaccggggttttaaccgggttaaccccgggggggtaaaccggggtaaaacccggggtaaacccgggttaaaagggggttaaccggggttaaaaaaccggttaaaacccggttaaaaaccccgggttaaaaaccgggttaacccgggttttagggaccccgggttaccggtttaaacccggaccccttttaaaaccccgttgtttacccgttttaacccgg

SEQ ID NO: 18919 - DNA, 752 bp, Homo sapiens
  misc_feature: GYAE6OF01CRO4Y.4.10.A10.1.454.CMB.1.raw
  modified_base (683)..(683): a, c, t, g, unknown or other
  misc_feature (683)..(683): n is a, c, g, or t
  modified_base (743)..(743): a, c, t, g, unknown or other
  misc_feature (743)..(743): n is a, c, g, or t
tcagagcactgtagcacgaccggtgctcgatttagcgtcgatctcgagggggagtcagtcccagtcaggacacagcatggacatggacgggtccccgctcagctccgtggggctcctgctgctctcggctcccgaggtcgccagatgtgccatccagttcgacccagtcctccatccctcctgtctgctatctataggagacagacgtccacctatccacgttcggccgggcagtcgaggtctattttacgtagtttattcgacctggtactacgaacgaaccgaaaaacgacggggaaacctccccgtaagtctacctagtactacgtagtcggtacgcctacttaccgtacgtttacgacggtaaacggtccgggtaccctagttaccggtaaggttccggaacggtccgggtaacgtaagggtggtaacgttccggtaacggggaacttacgttactttaccgtaccttaccgtaccaacccttataccggaaccgaccgtaacgaccccttaacgggacgtaaccgttaggttaactttatttaccgaaacctttaaccgttttactaacgacgttaacctaaaggttaacttaacttttaaaacgtaccgttccgaccgttctttacgggtaccggttaccggggacgggaacgggtaccttaagggggacgttaaanacccggttaaacaaaacggtacgtcgggttaccgacgttaccgccttaaacccgttgttntttacccgg

SEQ ID NO: 18920 - DNA, 734 bp, Homo sapiens
  misc_feature: GYAE6OF01CGEDL.4.10.A10.1.454.CMB.1.raw
  modified_base (274)..(274): a, c, t, g, unknown or other
  misc_feature (274)..(274): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgaccccagtctccatccctccctgtctgcatctataggagacagagtcacatcactgccgggcagtcgagggtctattttcagttattagcctggtatacagaacaaaaccgagggaaacncccctaagcctaccgtagtactcgtagtggtacgacacttcctacgtttcgacgtaaacggtcgggtaccctagtaccgtaaggttccgaggtcggacgtaggtcggacgttcggtagggactagttacgtttaccacttaccgtaccacctataccacgtccacgacccctaacgacgtaccgtaaggtaagttacgttttacgaacctttaaactttacgttaccgttacgtaaccgtaaacgttaccgtttaaacttttaaacgtaaccgtttaccggtacccgttacccgtttaaccggttacccggttttaacccgggggaccggggtaaaccgggtaaacccggtaaagggggttaccggaaacggtttaacgtaaacccggaaaacggttaaccggttagggtaccggtaccttaccgggtaacccctaacccgttagtttcccgttaacccg

SEQ ID NO: 18921 - DNA, 656 bp, Homo sapiens
  misc_feature: GYAE6OF01B9J7V.4.10.A10.1.454.CMB.1.raw
  modified_base (296)..(296): a, c, t, g, unknown or other
  misc_feature (296)..(296): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccgagggaaacgcccctaagctcctgatctatggtncatccatttgactaaaggtcggggtacccatcgaaggttcaggcggcaggtggatcgtgggacagtatttcactctacaccatcagcacgccctaacgacgcccgtagtaacgtactttttaggaaccttaaacttttattaaccgttacgtacctaaactaacggttaacctttaaaacttaaacgtttaaccggaccgttaccttaccgtaccggttttaccggggaccggggtaacggggtaacccgtaaagggggttacgggaaacggttaacgttaaacccggtaaaaaccgggtaaccgttaggggttaccgggtaccgttacggaacccgtaaccctagttcccgtttaccgg

SEQ ID NO: 18922 - DNA, 664 bp, Homo sapiens
  misc_feature: GYAE6OF01CN2VB.4.10.A10.1.454.CMB.1.raw
  modified_base (94)..(94): a, c, t, g, unknown or other
  misc_feature (94)..(94): n is a, c, g, or t
  modified_base (316)..(316): a, c, t, g, unknown or other
  misc_feature (316)..(316): n is a, c, g, or t
  modified_base (632)..(632): a, c, t, g, unknown or other
  misc_feature (632)..(632): n is a, c, g, or t
  modified_base (658)..(658): a, c, t, g, unknown or other
  misc_feature (658)..(658): n is a, c, g, or t
tcagagcactgtagcacgaccggtgctcgatttagcgtcgatctcagggggagtcagtcccagtcaggacacagcatggacatgagggtccccnctcagctcctggggctcctgctgccctggctcccaggtgccagatgtgccatccagttgacccagtctccatcctccctgtctgcatctataggagacagagtcaccatcacttgccgggccagtcagggctattttcgagttatttagcctggtatacagtaaccaaaaaaccgtagggaaaagcccccttaaagccttaccctaggaactctaagtggtnactattccctaacgttttgaaccgtaaaaggttcgggggtccccaaagttcgtaaaacgggtttccaaggcgggtaccaagggttggtaaactccgttgggaactacgtacttttccaacttcctacaacctaatcgaagaccaagtcccctaagacgtcctaaggtaattaagttttcgactaacctttattacctagttaccaaactagtactttaaagttactaaccgtcgtactacgtaccgtttcgggacggtaaggaaccctaagggtacggagtaaacttaccgaaaacggtaaaccttggtacccggngttaccgacctaaccgtattcggttnttaccc

SEQ ID NO: 18923 - DNA, 800 bp, Homo sapiens
  misc_feature: GYAE6OF01DKGEM.4.10.A10.1.454.CMB.1.raw
  modified_base (545)..(545): a, c, t, g, unknown or other
  misc_feature (545)..(545): n is a, c, g, or t
tcagagcactgtagcacgaccggtgctcgatttagcgtcgatctcgagggggagtcagtcccagtcaggacacagcatggacatgagggtccccgctcagctccgtggggctcctgctgctctggctcccgaggtcgccagatgtcgccatcctagttcgaccctagtcctccactccctcctgtctgctattactaagtaggagacgtagacgtccacactctacgtcggcccggactagccggaggtcttacttttacgtagtttaactttcggaccgttaggttacaacgaacggaaaccgaaaaaaccggaagggaaaccctaccctaaggtcccgttaccgtagtacgtttacgtaagttcggttacaccgtaccttaccgttaaccgtttaggtaaacccgggttaaacgggttcccggggttaaccctaacgttaccggtaaacgggttccgaaacgggttcccgggacgttagggtacgtacggtacggtaacgggtaaactagttacttacccgtactactaccgacttacgaacncgactacgacctacgtacgtcgttaagtaagtttacttaacgaacctttaaactttagttaaccgaacgttaaaccgaaatttcccggttaaaattttaaactaacccgggtttacgaaccccgtttacgtttcccgttaaacgggttacccgggggaaccggttaaaccgggaaccggttaaaggttacggaataaacccgaacgtaaaacggttcggtcgtacggaccacgttaacctactacttcggtaccc

SEQ ID NO: 18924 - DNA, 822 bp, Homo sapiens
  misc_feature: GYAE6OF01ESD1V.4.10.A10.1.454.CMB.1.raw
  modified_base (194)..(194): a, c, t, g, unknown or other
  misc_feature (194)..(194): n is a, c, g, or t
tcagagcactgtagcacgaccggtgctcgatttagcgtcgatctcagggggagtcagtcccagtcaggacacagcatggacatgagggtccccgctcagctccgtggggcctcctgctgctctggctcccaggtgccagatgtgccatccagttgacccagtctccatccctccctgtctgctatctatagganacagacgtcacctactcctaccgttcggcccgggaccaggtcgagggtctagttttacgagttatttacggccgtggtactacaagaaccgaaaaaccgacgggaacctaccccgtaagtcctaccgtagtacttacgtagtggtacgactactcctagtttcgacgtaacggtccgggtaccagtacgtaacggtcgacgggccgggtacgtagggtacggtacgttacgggtacggggtaaacctacggttacgtttaaccgtacttacccttacaacccgtacgtacccgtaacgacccgtaaccgtacccttaacggaaccggtaccgttaacggttaaacgttttacggttttaaccgaacccttttaaaacgtttaccggttttaaccgttaaccgtaaaccgttaaccgttaacgtttaaaccgtttaaacgttaaaacccggtttcccggacccgtttacccgtttaacccggtacccgggttttacggggaaccgggggtaaccgggtaaccgggtaaaacggttcgggtaaaccgtaagtaacccgggtaaaacgtacgggtttacgggacccgggttactacccgggtaccctaacttacggttcccgtttacccgg

SEQ ID NO: 18925 - DNA, 731 bp, Homo sapiens
  misc_feature: GYAE6OF01AER8X.4.10.A10.1.454.CMB.1.raw
  modified_base (145)..(145): a, c, t, g, unknown or other
  misc_feature (145)..(145): n is a, c, g, or t
  modified_base (162)..(162): a, c, t, g, unknown or other
  misc_feature (162)..(162): n is a, c, g, or t
  modified_base (515)..(515): a, c, t, g, unknown or other
  misc_feature (515)..(515): n is a, c, g, or t
tcagagcactgtagcacgaccggtgctcgatttagcgtcgatctcagggggagtcagtcccagtcaggacacagcatggacatgagggtccccgctcagctccgtggggctcctgctgctctggcctcccaggtgccagatgtcnccatccagttcgacccngtctccactccctccctgtctgcattctaagtaggagacagacgtccaccatcacgttcggccgggccagtcgagggcttattttctagtttattacgccttggtactacgacgtaaccaaaaaccggtagggaaaccgtacccccgttaagtccctaccgttaggtacttaccgttaaggttcggtaccggtaacctaccgttacctttaccgttttaggaccggttaaacggggttccgggttacccagttaccggtaacggttacgacgggtacggacctagggtacggtaccgtacggtacggggtaaactacgtttaacctttccgaaccgtttctacccgaaccgtnttacccgacgtccgaccgtaaccctacggtacgtaccgttagtaacgtttctttacgaactttaacgtttacttacgttcgaactacgtattaacgttaacttagtccgtcttaccgttaggttaccggtacgggacggtacgtaaccgtagggtcgaaactacgtaaccgaaggttacgttcgtacgacttccgacctaccgtagtccggttacc

SEQ ID NO: 18926 - DNA, 656 bp, Homo sapiens
  misc_feature: GYAE6OF01CIWFH.4.10.A10.1.454.CMB.1.raw
  modified_base (199)..(199): a, c, t, g, unknown or other
  misc_feature (199)..(199): n is a, c, g, or t
tcagagcactgtagcacgaccggtgctcgatttagcgtcgatctcgagggggagtcagtcccagtcaggacacagcatggacatggagggtccccgctcagctccgtggggctcctgctgctctggctcccgaggtcgccagatgtgccatccagttcgacccagtcctccatccctcctgtctgctatctagtagganacagagtccacatcacgttcggccggcagtcgaggtctagtttacagtttattcgccttggtactcgaagaaccaaaaaccggaggaaacctccctaaaggtccctaccgtagacttcgtagtcggtcgtactacgtcctagtttcgacgtaacggtcgggtaccctagtacgtaacggttcaggtcggactaggcggtactcggtaggactagtacttcacttcactacgtatacacgtacgacgtaccgtaacacggtacctaagtaacgttacgtttacgaaccttaacgtttacttaacgtactaaccgtaagttacgtaacttaagttaaccgtacgtacgttaccttaccggtaccgtttaccgggacgggtaccgggtaaaccgtaggtacggaagtacttaaccggaaacgttagcgttacgacctacgtacctacgtagttcgttacg

SEQ ID NO: 18927 - DNA, 735 bp, Homo sapiens
  misc_feature: GYAE6OF01ATQWI.4.10.A10.1.454.CMB.1.raw
  modified_base (191)..(191): a, c, t, g, unknown or other
  misc_feature (191)..(191): n is a, c, g, or t
  modified_base (276)..(276): a, c, t, g, unknown or other
  misc_feature (276)..(276): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctatagganacagagtcaccatcacttcggccggccagtcagggtctattttcagttatttagccttggtactcagacaaaaacgagggaaacncccctaagctcctagtactctatggtcactactcctactttgacgtaaacggtcgggtacccagtacgtaaggttcgaacgcggtcaaggtcggtaacttcggtacggggtaacctaggttaacttttaccaccgttacctaccgtaaccctaagtacccgaacggtacccaacgtacccctaaccggtaccggtaccccgtttaaagggtaaacgtttacgtttttacggaaccctttaaaccttttaacgtttaaccgttacggttaacctaaacgtaccgtttaaacctttaaagtaaccgtttaaccgcccgttaccttaccgttacccgggtttaccgggaccgggtaacggggtaacccgtaaaggggttaccggtaagtaaccgttaaacggaaaaccggttacgtacgggttacggtccgtacggaccctaaccgtaagttcccgttacgg

SEQ ID NO: 18928 - DNA, 779 bp, Homo sapiens
  misc_feature: GYAE6OF01EV0I2.4.10.A10.1.454.CMB.1.raw
tcagagcactgtagcacgaccggtgctcgatttagcgtcgatctcgagggggagtcagtcccagtcaggacacagcatggacatgagggtccccgctcagctccgtggggctcctgctgctctggcctcccaggtgccagatgtgccatccagttcgacccagtcctccactccctcctgtctgcatctagaggagacagagtccaccatctacttcggcccgggcagtcgaggtcttattttctagtttatttacgccttaggtactacaacgaaccaaaaaccggaagggaaaccgtaccccgtaagtcctccgtagtactaccgtagtggtacgactacttaccgttactttcggaacgtaacgggttccgggtaccctaagtaccggtaaacggttcgacgggtcggtacgtaagggttcggtacgttcggtaacgggtaactacgtttactttacccgacttacccgtaccaacctaacgtaaccacgaccgtaaccgtaccctaacgtaccgtaccgttaaggtaacgtttagttaccgttaacctttaaaccgttttaattaaccgttaccgtaacctaacgtaacgtttaaactttaaacgtaaccgtttaaccggtaccgttaccgttaccgttaaccgggtttaccgggaacccgggggtaaccggtaaccgggtaaacggggttaggtaacggtaaacccgtaacggtaaaaccggtagttacgggtaccggtaccgtccgtaaccgtacccgttacgttcgttaccg

SEQ ID NO: 18929 - DNA, 729 bp, Homo sapiens
  misc_feature: GYAE6OF01A989D.4.10.A10.1.454.CMB.1.raw
  modified_base (191)..(191): a, c, t, g, unknown or other
  misc_feature (191)..(191): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctccatcctccctgtctgcatctatagganacagagtcaccatccacttcggccgggccagtcagggtctattttcagtttattagccttggtactcaagaccaaaaaccgagggaaacgcccctaagtccctaccgtagtacttacgtaagtcgggtacgacctacttcccgtaagttttacggaaccgttaaaacgggttccgggggttacccaaggtttaccggaaacgggttttccgaacgggtaccgggtaccgtaggggttacgtacggttacggtacgggggtaactacgggttacttttaccgaccgttaccgttaccaaccgtgttaccgaacgacctaacgggtaccccttaacgaacggtaccctttaagggaacgttttacgttttaaccgaaccgtttaaaactttaacggttaccttacgtaaccctaaacgtacgttacttaaacgttacgttaccgccggtacttccgtacggttcggacggtacggaccgagggttgacgtaataccggaaacgtacgtcggtacgtaccgtacgactacctgtcgttacg

SEQ ID NO: 18930 - DNA, 718 bp, Homo sapiens
  misc_feature: GYAE6OF01BMJMR.4.10.A10.1.454.CMB.1.raw
  modified_base (308)..(308): a, c, t, g, unknown or other
  misc_feature (308)..(308): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctccatcctccctgtctgcatctataggagacagagtcaccatcacttggcccgggcagtcgagggtctattttcagtttattacgcctggtatcgagacaaaaaccgagggaaacgcccctaagctacctagacttctagtcggtnactactccttacgtttcgaaccgtaaagggttcgggtaaccctagtaccgtaaggttcgaacggcggacgtaggtaggacttacggtaggggactagttacttcctacttcctacctacctacgtccgaacgtcctacgtaccctaacgtacggccgttaaagtacgttaacgttttcgtaaacccttaagttttaagtttacccgttagtaaacctaaaccgttaagttaaaccgtttaaacgtttaaaccgttaccgtaccctttaaccttacccggttaaccgggtttaccgggaacccggggtaagggtaaacccggtagggggtaccgaacgttaaccgtaacggtaaaaccggttacgttgggtaccggtactcccggaactaccgtaacgttcggttaacccg

SEQ ID NO: 18931 - DNA, 769 bp, Homo sapiens
  misc_feature: GYAE6OF01AQYDV.4.10.A10.1.454.CMB.1.raw
  modified_base (95)..(95): a, c, t, g, unknown or other
  misc_feature (95)..(95): n is a, c, g, or t
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagagcactgtagcacgaccggtgctcgatttagcgtcgatctcagggggagtcagtcccagtcaggacacagcatggacatgagggtccccgntcagctcctggggctcctgctgctctggctcccaggtgccagatgtcgccatccagttcgacccagtctccatccctcccttgtctgctatctatagganacagagtccaccatccacgttcggcccgggccagtcgagggccttattttcagtttattacgcctaggtactcaaacgaccaaaaaccgaggaaccncccgtaagcctactgatctagtggtcgctactcctactttacgacgtaacggtcgggttacccatacggtaaggttcgaacggcggtacgaggtcggtacgtcggttagggactaacggttactttacgaaccttcctaccgaaccgtattacgagtacccgtacgaccccgttaacgtacggtacctttaaggtaaacgttttacgttttacgtaaacccgtttaaactttaatttacccgttaacgttaacccgtaaagtttaaccgttaaacttttaaaaccgttaacggtttacccgtacccggttaccctttaacggtttaccccgggtttaacgggggaccggggttaaaccgggaaaccgggtaaaggggttacgggaacgttaaacccgttaaaccggtaaaacgggttaacgttcggggtacggttacccgtaaccggtacccttaacccggtagtttccggtttacc

SEQ ID NO: 18932 - DNA, 760 bp, Homo sapiens
  misc_feature: GYAE6OF01BUE8R.4.10.A10.1.454.CMB.1.raw
  modified_base (97)..(97): a, c, t, g, unknown or other
  misc_feature (97)..(97): n is a, c, g, or t
  modified_base (202)..(202): a, c, t, g, unknown or other
  misc_feature (202)..(202): n is a, c, g, or t
tcagagcactgtagcacgaccggtgctcgatttagcgtcgatctcgagggggagtcagtcccagtcaggacacagcatggacatgacgggtccccgntcagctccgtgggctcctgctgctctggctcccgaggtcgccagatgtcgccatccagttcgacccagtcctcctactccctcctgtctcgctatctagtagganacagtacgtcaaccatccgtacgttcggcccggactagtcgaggtcttagttttcgagtttattacgccttaggtactacgaacgtaaccgaaaaacgacgggaaacctaccccgtaaagtccgttaccgtagtacttcgtagttcggctacctactaccctagtttacggaaccgttaacgggtccggtaccctaacgttacggtaacgttcgaccggtacggtacgtaacgggtgtacgtcggtaagggtacctaggttactttacccgtaccttccgtaacctaaccgtaccgttaacaccgtacctaaccggtaccctacggtaaccgtccgttaacggtacgtttaacgtttaccgaacctttaacgtttacctacggtacgtaaccctaacgttaacttaaccgttaacgttaaccgttccgtacggttacccttacggttaccggttaccgggacgggtaaaccggtacggtaagggtcgtaacgtaaccgtaaacggaacggttaccgtcggtaacgtccgtaacgtacctaccgttgttccgttacccg

SEQ ID NO: 18933 - DNA, 677 bp, Homo sapiens
  misc_feature: GYAE6OF01A8TKK.4.10.A10.1.454.CMB.1.raw
  modified_base (200)..(200): a, c, t, g, unknown or other
  misc_feature (200)..(200): n is a, c, g, or t
  modified_base (535)..(535): a, c, t, g, unknown or other
  misc_feature (535)..(535): n is a, c, g, or t
tcagagcactgtagcacgaccggtgctcgatttagcgtcgatctcagggggagtcagtcccagtcaggacacagcatggacatgagggtccccgctcagctccgtggggcctcctgctgctctcggctcccgaggtcgccagatgtgccatccagttcgacccagtcctccacttccctccctgtctgcatctagagganacagatccacatcgacgtcgccggcagtcgaggtacttatttcgtagtttattacgccgttaggtacacgaagaaccgaaaaaccggtacggaaacccgtacccctaagtcctaccgtagtacgtccgtaagtggtaccactaccttaccctacgtttagaacgtaacgggttccggacctaacgttcgtaacggttccgaggtccggtacgaggtacgtacgttccgggtaggaacttacgttaccttcaccgttccaccacgtactaccgagaccctacgaccctacggactaccggtagttagttactttcgaactttaagtttctacgtanaccgtaatacttaacgttaatacgttaccgcttaactccggttacggtaacggggcggtaaccggtacgtaagggtagaacggtacctaaaccgggaaactagggtacggtcgcctaccggacctacttagtccgttacccg

SEQ ID NO: 18934 - DNA, 707 bp, Homo sapiens
  misc_feature: GYAE6OF01CAGMN.4.10.A10.1.454.CMB.1.raw
  modified_base (150)..(150): a, c, t, g, unknown or other
  misc_feature (150)..(150): n is a, c, g, or t
tcagagcactgtagcacgaccggtgctcgatttagcgtcgatctcgagggggagtcagtcccagtcaggacacagcatggacatggacgggtccccgctcagcctccgtggggctcctgctgctcgtcggctccgaggtcgccagatgtnccatccagttcgacctatctccactcccgtcctgtctcgctatactagaggacgacaggactacactaatcgacgttcgggaccggacctaggtacggacgggtacttacgttttacgaagtttacgtttacgccgttaggtaactacgaacgaaaccgtaaaaaccggaagggaaacccgtaccgtaaacgtccgttaaccgtagtaactacgttaacgtcgggactactacctactacgttacgaacgtaacggtcggtaccagtacgtaaggtcgaggtaccgagtagtaggacgtggtacggtactacgttactacgacttacacctaacgtacgaccacgtacacacccgttacgacgtacgtaagtaacttcgtttacaacgtttaacttacgtacttacgaactagtaacttaacttaacgttagtaccgtacgtacgttaaccgtacggtacggggacggtaaaccgggacgtaaggacgtaaacgtaccgtaaacgaaacggtacgttcggtacgtacttaccgaacttaccgttagtccggtttaac

SEQ ID NO: 18935 - DNA, 772 bp, Homo sapiens
  misc_feature: GYAE6OF01EH497.4.10.A10.1.454.CMB.1.raw
  modified_base (96)..(96): a, c, t, g, unknown or other
  misc_feature (96)..(96): n is a, c, g, or t
tcagagcactgtagcacgaccggtgctcgatttagcgtcgatctcagggggagtcagtcccagtcaggacacagcatggacatgacgggtccccgntcagctccgtggggctcctgctgctcgtggcctcccgaggtcgccagatgtcgccatccaggttcgaccctagtcctcctacgtccctcctgtctgctatactagtaggagtacgagtacgtccaacctagtacctacgtcggacccggacacggttacgagggtcttactttttacgtaagttttacgtttacgaccgttaggtactacgaaacgtaaaccgaaaaaccggtaacgggtaaacccgtaccccgtaacgtaccgttccgtacgtatacgttaggtcggtacgtactaccttaccgttacgtttacggaacggtaacggggtccggtaaccacgttacgtaacggtcgaacgggtacggacgtggtacggtacgtcggtaggtaactaggttacttacacccgttctaacacttagaccgtacgaccgacgtacctaacgtacgtacgttacttaacgttacgtttaacaacttaaccgtttaacgtacgttaaccggtaactaaacggtttcctttaaacttaacgttaaccgttcgtaacgttccgtaaccggttacgtacggggacgggtaaccgtaaacgggttaggacggaacgtaaacggtaaccgtaaacgtaggtacggttacgtaccgttaagaacccgtcttacggttccgttaccg

SEQ ID NO: 18936 - DNA, 638 bp, Homo sapiens
  misc_feature: GYAE6OF01DLP72.4.10.A10.1.454.CMB.1.raw
  modified_base (260)..(260): a, c, t, g, unknown or other
  misc_feature (260)..(260): n is a, c, g, or t
  modified_base (457)..(457): a, c, t, g, unknown or other
  misc_feature (457)..(457): n is a, c, g, or t
tcagagcactgtagcacgaccggtgctcgatttagcgtcgatctcagggggagtcagtcccagtcaggacacagcatggacatgagggtccccgctcagctcctggggctccctgctgctctggctcccaggtgccagatgtgccatccagttgacccagtctccatcctcctgtctgcatctataggagacagagtcacatcacttgccggccagtcagggctatttcagttattagcctggtatcagacaaaaaccgnggaaacgcccctaagcctcctgatctagtggtgctatcctactttgacgtaaaggtcgggtacccatacgaacggttacacggacggtacgaagggtacggtactacgtacggggacctaggtacttttaccaaccttcttaccaaccctaagtccaacggtaccaacgtcccttaacacggtacctagtaacgttnttttacgacttaacgttatttacacgtaacaactacgtaacttaaagttaacgttacgccgttacttaccgtacggtttaccgggaccggtaaggggtaccctaaaggggtcgtaaacggtaattaaccggaaaacggtaaccgttgtaccggtctaggaccctaaccgtgttccgttacg

SEQ ID NO: 18937 - DNA, 645 bp, Homo sapiens
  misc_feature: GYAE6OF01EKHGU.4.10.A10.1.454.CMB.1.raw
  modified_base (641)..(641): a, c, t, g, unknown or other
  misc_feature (641)..(641): n is a, c, g, or t
tcagagcactgtagcacgaccggtgctcgatttagcgtcgatctcgagggggagtcagtcccagtcaggacacagcatggacatgacgggtccccgctcagctcctggggctcctgctgctctggcctcccaggtcgccagatgtcgccactcccgagttacgacccagtcctccactccctcctgtcctgctatctagtaggacgacagtacgtacaacctatcctacgttccgggcccgggtccagtcgacgggtactacgttttctaagtttagttacgtccgttagttatacgaacgaaaccgaaaaaccggaacgggaaacctaccccgtaacgtcctacctagtacttacgtagtggtcgacctactccttacgttcgacgtaacggtccgggtacctacgtacgtaacggttcgacgcggtacgtaggtagtacgtcgtacggactacgtacttaccgctacctacaacctaccgacaacgctacgtcccaagccgtacgtacgttagttacgttactacttaacttacttactacgtacaactataacgttaatacgtactcgtactcggtacgtcggacggacgtcggaagtacgactacgaactaacgcgtgacgtctacacgttactgtntccg

SEQ ID NO: 18938 - DNA, 721 bp, Homo sapiens
  misc_feature: GYAE6OF01EO7RZ.4.10.A10.1.454.CMB.1.raw
  modified_base (95)..(95): a, c, t, g, unknown or other
  misc_feature (95)..(95): n is a, c, g, or t
  modified_base (665)..(665): a, c, t, g, unknown or other
  misc_feature (665)..(665): n is a, c, g, or t
tcagagcactgtagcacgaccggtgctcgatttagcgtcgatctcagggggagtcagtcccagtcaggacacagcatggacatgagggtccccgntcagctcctggggctcctgctgctctggctcccaggtgccagatgtgccatccagttcgacccagtcctccatccctccctgtctgcatctagtaggagacagagtccaaccatcctacgttcggcccgggccaggtcgagggtctattttctagtttagttacgccgttaggtactacaagaaccaaaaaccggacgggaaaccgtacccctaagtccctaccgtagtacttcgtaagtcggtcgtacctacttacccgttacttacggaacgtaaacgggttccgggtaccctaagtaccggtaacggttcgacggtccggtacgtaggtacggtacgttacggtagggtaacgtacgttacttaccgtaccgttcctacccgactacgtaccgagacccgtaacgtacccgtacgacggtaccgttaagttaacgtttcgtttaacgacctttaactttacgttactacgtaacaacgtactttaacttaacttaccgttacgccgttacttaccggttacggttccgggaacgggtaacggtaccgaaggggttcgaacggttaanaaccgtaaacgtaccgggtgtacggtcccacggaccttaccgtagtccgtttaccg

SEQ ID NO: 18939 - DNA, 752 bp, Homo sapiens
  misc_feature: GYAE6OF01AD3DW.4.10.A10.1.454.CMB.1.raw
  modified_base (96)..(96): a, c, t, g, unknown or other
  misc_feature (96)..(96): n is a, c, g, or t
  modified_base (123)..(123): a, c, t, g, unknown or other
  misc_feature (123)..(123): n is a, c, g, or t
  modified_base (139)..(139): a, c, t, g, unknown or other
  misc_feature (139)..(139): n is a, c, g, or t
  modified_base (193)..(193): a, c, t, g, unknown or other
  misc_feature (193)..(193): n is a, c, g, or t
  modified_base (712)..(712): a, c, t, g, unknown or other
  misc_feature (712)..(712): n is a, c, g, or t
tcagagcactgtagcacgaccggtgctcgatttagcgtcgatctcagggggagtcagtcccagtcaggacacagcatggacatgacgggtccccgntcagctccgtggggcctcctgctgctntcggctcccgaggtcncagatgtcgccataccgagttcgaaccctgtcctaccactcccttcccgtgtcncgactatacgtaagaggaacgacgagactaccacctactaccgtacgtcgggcccgggtacaggtacgcgggttactttacgtttacgtacgttttacgtaccgtacgttaggtactaacggaaaccgtaaaccggaaaaaccggtacgggtaacccctcccgtaaacgtcccgttaacgtagtacctacgttaggtcgtacgtacctacgtccgtaacgttacgaacgggttacggtccgtaacctaagtacggttaacgcgaggtctacggtaggtcgacggttaggtcggaccgttaagttccctaacgtccgactaccacgctaaccggctaccggaccgttcaacggtccagttaacggtattaacgtcctaattacgttacgtactaacgaacttaacgtctttaaacctacgtacgtacccgtcttccggaaccggttaacgggtaccgggtacggtaacggtaaacggacggttaactaaacggaacgtaaaccgtcggttacgggtaacnccggtaaccgttgaaccccgtacgtttcgcgtttacccgg

SEQ ID NO: 18940 - DNA, 568 bp, Homo sapiens
  misc_feature: GYAE6OF01A7SX5.4.10.A10.1.454.CMB.1.raw
  modified_base (361)..(361): a, c, t, g, unknown or other
  misc_feature (361)..(361): n is a, c, g, or t
  modified_base (448)..(448): a, c, t, g, unknown or other
  misc_feature (448)..(448): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagtctggtatcagacaaaaccaagggaaagacccctaacgactcctgatctatggtgcactacctactttagtcaaacgtaggggtaccctatctaaggttacacgcggcgagtggagtacgngggacgagtatttacacgtctacaccatcagcacgccctaacagcctagaacgtattttagactaaacttacttactagtacctaanaagtaccttaattaaattacgcctcgttacctacgtttccgggacggacggggtaaccaaaggggtgaacgtaatacgaaaaccgaactaggtaggtacgtagaccacctagtccttacg

SEQ ID NO: 18941 - DNA, 774 bp, Homo sapiens
  misc_feature: GYAE6OF01D0VZ7.4.10.A10.1.454.CMB.1.raw
  modified_base (99)..(99): a, c, t, g, unknown or other
  misc_feature (99)..(99): n is a, c, g, or t
tcagagcactgtagcacgaccggtgctcgatttagcgtcgatctcgagggggagtcagtcccagtcaggacacagcatggacatggacgggtcccccgntcagctccgtggggcttcctgctgctgtggcctcccgaggtcgccagatgtcgcctactccgagttacgaccctagtcctcctacttccctcccgtgtctgactatacgtaagtaggacgacaggtactaccaaccactccgtacgttcgggcccggtactacggtcgtacgggtacttttacgttttacgttaagtttacgttacgtccgttaggtaacttacgaaacggaaaaccgaaaaaccgggtacgggaaaccctacccgtaacgtccgtaccgtaaggtacttacggttagtcgtacgtactaccgttccgttaacgtttacggaacggttaccgggttaccggtaccgtaacgttaccggttaaacggtcgaacgggtcggtacggtaggtacggtagttacggtacgggtaacttacgtttaccgttacctaccgtacttaacccgaacttaccgacgtaccgacgtaaacctcgtaacgaccgtattaaggttaacgtttcttaaccgtaaccgtttaaccgttcgttaactaacgtacgtaacttacgtaaactttaagtccgtacctcgtaacgttacgacggggttacgtaacgggacgttaaggtacgggagtacgtaatacggtaacgtgtacggtacgatccaagtaccttcgtgtacc

SEQ ID NO: 18942 - DNA, 862 bp, Homo sapiens
  misc_feature: GYAE6OF01CV6W0.4.10.A10.1.454.CMB.1.raw
tcagagcactgtagcacgaccggtgctcgatttagcgtcgatctcagggggagtcagtcccagtcaggacacagcatggacatggacgggtccccgctcagctccgtgggcctcctgctgcctcgtcggcctcccgaggtcgccagatgtcgccactccgtagttcgacccagtcctcctactccctcctgttcctgctactctagtaaggacgacagtacgtaccaccctataccgtacgttccggcccggggaccctaggtccgagggtcctttagttttactaagttttacgttacgtccgttaggttaactacaacggtaaaccaaaaaccggacgggtaaaccgtacccctaacgtcctaccgtgtaacttacgtacggttcggtactacttacgtcctttacgttacggaacgttaacgggtccggttaccctaacgttaccggttaacgttcggacggtacgggactacgggtacgtagtccggtacgggacttacggtacttcctaactcccgtacaacccgttacgcaaccgcgtaacctacccgtacgaccgtaccgtagtaactttaacgttaccgttaacttaaacttttacgttaaccctagtaaaccctaacggtttaactttaaaccgtttaaaacgtttacccgttacccgttacccttaacccgttttacgggtaccccggggtttaaccgggggaaccggggtaaacccgggtaacggggttaacggggggttaactaaacgggttaaaccccggtaaaccgggttaaaacggaaccccgggtttggggaccccggtttacctaccggttaaacccgttacttacccgttttcggttaaccccg

SEQ ID NO: 18943 - DNA, 934 bp, Homo sapiens
  misc_feature: GYAE6OF01E00N1.4.10.A10.1.454.CMB.1.raw
  modified_base (190)..(190): a, c, t, g, unknown or other
  misc_feature (190)..(190): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctcctgtctgcatctatagganacagagtcaccatcacttcggcccgggccagtcagggctattttcagttatttagcctggtactcgaagacaaaaaccgagggaaacgacccctaaagcctcctagacttctaagtggtgacctactccttaacgttagacgtaaaagggttccgggggtaccctaacgtcgtaaacggtttcgaacgggacgggtacgacggttagggtacttccggtaggggtaacctaggttactttacacgttcctaaccctaacctacgtacctagaccgaacgttaccccgtaacgtaccggtacgttaacggtaacgggttacttttttaacgggaaacctttaaaccgtttttaacgtttaaccgtttacggtttaaacccgtaaaacggttaaacgttttaaaccgttttaaaaaccgttaaaccgtttttaacccggtaacccggttttaacccgttaacccgggttttaaaccccggggtttttacggggggttaaacccccggggggtaaaaccggggggttaaaaaccccggggttaaaacggggggtttaaacggggtaaaaccgggttaaaaaccccgggtttaaaacccgggaaaaaaaaacccccggggttttccgggttttaaaacggggggttttaacccggggtaaacccccggttttacccggggaaaacccccgttttaaaacccccccgggtttaagtttaaaccccgggggttttttttaaccccccggg

SEQ ID NO: 18944 - DNA, 746 bp, Homo sapiens
  misc_feature: GYAE6OF01CZSGF.4.10.A10.1.454.CMB.1.raw
  modified_base (204)..(204): a, c, t, g, unknown or other
  misc_feature (204)..(204): n is a, c, g, or t
tcagagcactgtagcacgaccggtgctcgatttagcgtcgatctcgagggggagtcagtcccagtcaggacacagcatggacatgagggtcccccgctcagctccgtggggctcctgctgctctggctcccaggtgccagatgtgccatccaagttcgaccctagtctccatccctccctgtcctgcatctataggagtacagngtccacatcacgttggccgggcaggtcgagggtcttagtttcaagttacttagcctggtactcgaagacctaaaaaccgagggaaacgcccctaaagtcctcctagtaactccgtaagttcggtacgtacctaactacccgttacgttttacggaaccgtaaacgggttccggggtacccctagtaccggtaacggtttaccaagggtccgggacgtaggttacggtactacggtagggtacgtaacgtacttttaccgaccttaccgttaccaaccctagttcccgaaacgtcccgtacgaccccgttacgtaacgtaccgtagttaacgtttacgttttacaaccgtttactttaaactttaccgcgttaaactaaccgtaactttaacttaaacgtttaaccgtccgacgttacctaccgttccggttaacccggggacggtaacggggaacccgtagggtacggtaaacgtaaccgtaaccgaaaacggttaccgtggttaccggtactacggacccaaccgttgttcggtttacccg

SEQ ID NO: 18945 - DNA, 793 bp, Homo sapiens
  misc_feature: GYAE6OF01ALEBW.4.10.A10.1.454.CMB.1.raw
  modified_base (97)..(97): a, c, t, g, unknown or other
  misc_feature (97)..(97): n is a, c, g, or t
tcagagcactgtagcacgaccggtgctcgatttagcgtcgatctcgagggggagtcagtcccagtcaggacacagcatggacatgacgggtccccgntcagctccgtggggctcctgctgctctggcctcccaggtcgccagatgtcgccatccagttcgacccagtcctcctactccctcctgtctgacctaattcgtaagtaggacgaacgaagacggtaccaccgtaattcctaccgttcgggaccccgggtacctaaggttaccgagggtacttagttttttacgacgttttatttacggtccgttaggttaactaccgtaacggaaaccgtaaaaaaccggaacggggtaaaaccgtaacccccgtttaacgacccgtttaccgttacggtacctttacgttacgtacgggttactacctaccgtttacctacgttttacggaaccgttaaacgggttccggggttacccaagttaccggtaaacggttcgacggtcggacgtacggtacggtaacgtcggtacggagtacgttacttcgtacctacgtaccaacgtataccggacacgtaccgttacccgaacgtacgtacgtaagtacgttacgtttacgaccttaacgttacttcgtacaacgtaacgtagttaaccttaaagtaccttacggaccgtacttacccgggtacgttacgggtaccgggtaccggtaacgtaacgggtaggtaccgttaacggaactaaccggttacgtacgtacgtacggtacacccgtaacttgtaccgttaccg

SEQ ID NO: 18946 - DNA, 687 bp, Homo sapiens
  misc_feature: GYAE6OF01CE2R8.4.10.A10.1.454.CMB.1.raw
  modified_base (195)..(195): a, c, t, g, unknown or other
  misc_feature (195)..(195): n is a, c, g, or t
  modified_base (344)..(344): a, c, t, g, unknown or other
  misc_feature (344)..(344): n is a, c, g, or t
  modified_base (677)..(677): a, c, t, g, unknown or other
  misc_feature (677)..(677): n is a, c, g, or t
tcagagcactgtagcacgaccggtgctcgatttagcgtcgatctcagggggagtcagtcccagtcaggacacagcatggacatgagggtccccgctcagctccgtggggctcctgctgctctggctcccaggtgccagatgtgccatccagttcgacccagtcctccatccctccctgtctgcatctagtagganacagagtaccacctatcctacgttcgccgggccagtcgacgggtctattttctagtttacgttacgccgttaggtatcgaacgaaccaaaaacggtacgggaaaccgaccccgtaacggtcctaccgtagtaacttcttaagtggtacnctacttaccgtacgtttacgacgtaacggtccgggtacctacgtacgtaacggttcgacggtcggcgtacgggtaggtacgtaccgtagggactaggttacttcctaccgttacctaccgtacccataccgacgtaccgacgtacccttaccgacgtaccgtaggttaacgttacttttaacgaactttactttacttacgtacgtaacctaacgtagttaacttaatacgttaccgacttccgttacgttaccggtcgggacgggtacggtaaacggtagggtacggaatacgtaccggaaagtacgtggtcgtacgtaccgactacccgtnttccgtaccg

SEQ ID NO: 18947 - DNA, 849 bp, Homo sapiens
  misc_feature: GYAE6OF01EUL8S.4.10.A10.1.454.CMB.1.raw
tcagagcactgtagcacgaccggtgctcgatttagcgtcgatctcgagggggagtcagtcccagtcaggacacagcatggacatgagggtccccgctcagctccgtgggctcctgctgctctggcctcccaggtgccagatggtcgcccatcccgtagttcgaccctagtcctccactccctccctgtctgctatctaagaggagacagagtaccacctatctacgttcggccccgggcctaggtaccgaacgggtccttaatttttccgtagttttaaccgttttacgcccgtttaggtaaccttacgaaacggtaaaccaaaaaaccggaacgggtaaaaccccgtacccccgtaaaggtcccttaaccgtagtaacgtttaccgtaacggttggtacctccctaacttccccttaagtttcgaaccgtaaacgggtacccgggtaccctaaggttaccgtaaacggttccacgggtacggtaccgtaaggggtttaggtaaccggttacgggtacgggtaaacgtaagtttaccgttttacccgaacctttcctaaccgtaccctaataacccgtacgacgtacccgtaacccttaacggaaccgtcgttaaaccgtaagtttaagtttaccgtaaccgttaacctttaagttaccctttaccggtaacctaaacgtacgtttaaaccgtttaacgtaaaccgtttcccgaccttaacgttaccgtaaccggtttaccggggacgtaaaccggggtaaccggtaagggtaacggtaacgttaacgtaaaccggtaaaaccggtgtacggtcggtacctacgtaacccgcttacgtccgtttaacgg

SEQ ID NO: 18948 - DNA, 830 bp, Homo sapiens
  misc_feature: GYAE6OF01A9SDI.4.10.A10.1.454.CMB.1.raw
  modified_base (98)..(98): a, c, t, g, unknown or other
  misc_feature (98)..(98): n is a, c, g, or t
tcagagcactgtagcacgaccggtgctcgatttagcgtcgatctcgagggggagtcagtcccagtcaggacacagcagtggacatggacgggtccccnctcagctccgtgggcctcctgctgctcgtcggcctcccgaggtcgccagatgtcgcctatccgtagttaccgaccctacgttcctacctaccttcccctccgttagtctcgactacgttacgtaaggaggacgaacgtacgtagtaccacctacttacgaaccgttcgggacccgggtacctaggtccggaacggttcttagtttacgtaagttacgttacgtcgttaggtactaacgaaacgaaaccgaaaaacggtacggaaaccgtaccgtaacgtccgtaacgtacgtacgttacgtacggttacgtacgtacctaaccttacctaccgtttaaggaaccggttaaacgggtccggtacctaacggtacgtaacgtacggacgtacggtgtaaggtacggtacgttacgggaacgtacgtacgttacttaccgattacccgtacgtaacctcgtaacctaccggaaccgtacccgtaaccgtaacgtacgtaacgttaaggtaactttaccggttacgtaaacctttactttaacggtacttaacgaaaccgttaagtaacgtttaacttaaaccgttaccggtaccgttaccgttaccgttaacggggttacgtaccggggaaaccggtacggtaaaccgggtaggttaaacggaaacgtaaccgtaaacggtaaaccgtgtacccggtaggaacgttacccgaacctttcgttccgtacgttaccg

SEQ ID NO: 18949 - DNA, 748 bp, Homo sapiens
  misc_feature: GYAE6OF01BYQYX.4.10.A10.1.454.CMB.1.raw
  modified_base (196)..(196): a, c, t, g, unknown or other
  misc_feature (196)..(196): n is a, c, g, or t
tcagagcactgtagcacgaccggtgctcgatttagcgtcgatctcgagggggagtcagtcccagtcaggacacagcatggacatgagggtccccgctcagctcctggggctcctgctgctcgtggcctcccaggtcgccagatgtgccatccagttcgacccagtctccatccctccgtgtctgcatcagtagganacagactcaccatctacgttcggccggacctagtcgaggtctacttttacgaagtttactttacggccgttaggtaacaccgtaacggaaccgaaaaaccggacggggaaaccgacccccttaaaggcccttaccgtagtaacttctaaggtcggtacacctacttacctacgtttacgacggtaaacggtccgggtaacctataacggtaggtcacgggccgagtaggtacggtacgtcggtagacgtacgttactccgacttccaacacctataccgacggacctaacgtacccaacgtcgtacggtacgttaagggtttacctttaacggaactttaaccgtttacgttactacggtaaaccaccgttaaattaaccgttaactaacggttacccgtattcccgttaacggttaccgggttaaccggggacgggtaaaccggaaaccggtaagggttacggaacggttaaccggtaaccggtaaaacgggttcggtacgggtccgggtacctacccggtacccgttaaccttccggttccgtttaccgg

SEQ ID NO: 18950 - DNA, 724 bp, Homo sapiens
  misc_feature: GYAE6OF01DU1B3.4.10.A10.1.454.CMB.1.raw
  modified_base (207)..(207): a, c, t, g, unknown or other
  misc_feature (207)..(207): n is a, c, g, or t
  modified_base (686)..(686): a, c, t, g, unknown or other
  misc_feature (686)..(686): n is a, c, g, or t
tcagagcactgtagcacgaccggtgctcgatttagcgtcgatctcgagggggagtcacgtcccagtcaggacacagcatggacatgagggtccccgctcagctccgtggggcctcctgctgctctggcctcccgaggtgccagatgtgccactccgagttcgaccctagtcctccacttccctccctgtctcgctatctagtagganacagacgtcaccatctacgttcggccgggccaggtcagggtcttacgttttactagtttatttacgccgttaggtactacgtaagaaccaaaaacggaacgggaaacgtacccctaacgtccgttaccgtacgacttacgtagttcggtacgtacctacttacctacgtttacgaacgtaaacggttacgggtacctaagtacggtacgttacgtacggtcggacgtacggtcgacgttacggtacgggactacggtactttactccgttactaccgtacgtaactaccgacgacctacggtacccttaaacgaccggttacttaaggtaacttttacgttttacgaaccgtttaatttactttaacgtactaacctaagttaacttaacgtttaattacgtaccgtcttacgtacgtaggttaccgggaccggtaacgggtacgtaaggtacggacgttaataccggaaaaccggttnttacggtaccggtctacgtaccgtactactttcgtacg

SEQ ID NO: 18951 - DNA, 863 bp, Homo sapiens
  misc_feature: GYAE6OF01EJVJB.4.10.A10.1.454.CMB.1.raw
tcagagcactgtagcacgaccggtgctcgatttagcgtcgatctcgagggggagtcagtcccagtcaggacacagcatggacatgacgggtcccccgctcagctcctggggcctcctgctgctctggcctcccaggtgccagatgtgcctatcccgagttcgacccctagtcctaccgtacttccctcccgtgtacctcgacctatactagtagggacaccgaagtacgtccaacctatcctaacgttccggcccgggtaccaggtccgagggtccttagttttacgtagtttacgtttacgtccgttaggtacttacgaacggaaaccaaaaaccggtacgggaaacccgtaccccgtaacgtaccttaccgtaggtaaccttacgtagtcggtacgtacctacgttacccttacgtttacggaacgttaaccgggttcggggtaccctacgttaaccgtaaccggtttacgacgggtaccggtacgtacggttcggtaacgttccggtaaggggtaccgtaacgtttaacctttaccgtaccgttaccctaccctaaccgtacgtaccgtaacggacctaaccggtaccccgtaacgtaaccggtacccgttaaagggttaaccgtttacgtttaaccgtaacctttaaacgttttaccgttaaaccgttacgttaaccctaaacggttaacgtttaacctttaaagtaacccgttaccgtacccgttacgttaacccgttaaccggtccggggtaccggtaaaaccgggttacggtaaacgggtacggtaaaccgtaaggtaaaccgtaaaccgtcggtaggtaccgtaccgactacccgtacgttccgtacgttacccg

SEQ ID NO: 18952 - DNA, 934 bp, Homo sapiens
  misc_feature: GYAE6OF01BX3L4.4.10.A10.1.454.CMB.1.raw
  modified_base (97)..(97): a, c, t, g, unknown or other
  misc_feature (97)..(97): n is a, c, g, or t
tcagagcactgtagcacgaccggtgctcgatttagcgtcgatctcagggggagtcagtcccagtcaggacacagcatggacatggacgggtccccgntcagctccgtgggctcctgctgctcgtcggcctcccgagggtcgaccagatgtcgacctactccgtagttccgaccctagtcctcctacttccctcctgtcctgcttatctaagtacgggaacaacagaccgtaccaacctatacctacgtccgggaccggacctaggtacggacggtacttacgttttagtaacgtttattacgcgttaagtacacgaacgaaacgaaaaccgaacgggaacctacccgtaaggtcctacgtacgtacttacgtagtcggtactacgtaccttaccgtagtttacggaaccggttaaggtacccgggtactacggtaacgtacggtacgacggtacgggtacgtagggtacggtaacgttacgggtacggtaaacgttacgtacttacccgtaacttccgacccgtaactaaccgtacgtaacgtaccgttaaccgtaccccgttaaaggaccggttaaccttaaacggggtttaactttttaacccgtttaacggttaaacccctttaaacgtttaaacccggttttctaaaacccggttaaccggttaaacgttttaaacccttttaaacgttttaaaaacccgtaccggtttaacccggttacccgggtttaaccggtttacccccggttttaaacggggggtacgggggaaacccggggttaaaacccggggggtaaaccgttaaaccgggggtaacgtaaaacccgggttaggtaaaaacccccggttaaaagggttaccgggtttaggaccccgtttaaacccggggaacaacccccgtttaacggttttacttcccggttttaaacccg

SEQ ID NO: 18953 - DNA, 660 bp, Homo sapiens
  misc_feature: GYAE6OF01CXUKX.4.10.A10.1.454.CMB.1.raw
  modified_base (95)..(95): a, c, t, g, unknown or other
  misc_feature (95)..(95): n is a, c, g, or t
  modified_base (192)..(192): a, c, t, g, unknown or other
  misc_feature (192)..(192): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (602)..(602): a, c, t, g, unknown or other
  misc_feature (602)..(602): n is a, c, g, or t
tcagagcactgtagcacgaccggtgctcgatttagcgtcgatctcgaggggagtcagtcccagtcaggacacagcatggacatgacgggtccccntcagctccgtgggctcctgctgctctggctcccgaggtcgccagatgtcgccatccagttcgacccagtcctccactccctccctgtctgcatctanaggagacagagtccacatctactcggccggcagtcgaggtcttagtttcaagtttacttacggccgttggtaactccgaacgaaaccgaaaaaaccggaagggtaaaccnccccgtaaagcctaccgtagtactctagtcggtacncctatccctactttgaacgtaacggtccgggtaccagtaccgtaaggttcgaacggtcgacgtaggtacggtacgtcggtaacggacgttaagttacctttccgtacctacgttccaaccctacgtacgacgacgtaccgtaaccctcgtaacggtaccgtagtatttacgtttaccgacttaactttactagtactaaccctataacttacttaataccgtcgacttctacgttaccggtggtaaccgggaacgtacgaaggngaacgtacgaaacgtaaccgtaggtcgtacggtctaccaacctccgtgttccgttacg

SEQ ID NO: 18954 - DNA, 722 bp, Homo sapiens
  misc_feature: GYAE6OF01ALEOL.4.10.A10.1.454.CMB.1.raw
  modified_base (281)..(281): a, c, t, g, unknown or other
  misc_feature (281)..(281): n is a, c, g, or t
tcagagcactgtagcacgaccggtgctcgatttagcgtcgatctcagggggagtcagtcccagtcaggacacagcatggacatgagggtccccgctcagctccgtggggctcctgctactctggctcccaggtgccagatgtgccatccagttcgacccagtctccatccctccctgtctgcatctataggagacagagtcaccatcacgttcgccggcagtcagggctattttcagtttattacgccttggtactactagaaccaaaaccgagggaaacnccccgtaagcctaccgtagtatctagtggtcgactactacctacttacgacgtaacggtccgggtaccagttacgtaacggttaccagggaccggtacgaggttcggtacgttcggtagggacgtacgtactttaccacgttcctacctacctacgtacgacggctaccggtaccctacgacgtacccgtagtaaccgtttacgttttaccgaaccgtttaaactttacgtttaaccgtcttaaccgtaaacgttacgttaaacctttaaagttaaccgttaaccgtccgttaccgttaccgttaccgggttaccgggaaccggggtaacgggaccggttaaacgggtagggaaaccgttacgtaaacccgtaaacggttaccggtagggtaccgtacgtaccggacccttaaccgtacgtttaccgttccgtttaacccg

SEQ ID NO: 18955 - DNA, 509 bp, Homo sapiens
  misc_feature: GYAE6OF02IBSRD.4.10.A10.1.454.CMB.1.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (381)..(381): a, c, t, g, unknown or other
  misc_feature (381)..(381): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccattccagttgacccagtctccatcctccctgtctgcatctagtaggagacagagtcaccatcacttgccggccagtcagggcattttcagttatttagcctggtatcagcaaaaaccngggaaanccctaagctcctgatctatggtgcatccatttgctaaagtggggtcccatcaaggttcagcggcagtggatcgtgggacagtatttcacttctcaccatcagcagcctacngacctagaagtattttgactaaacttattactgtacaacagtactttaataattacgctcttcactttcggcggaggaccgaaggtggagtaatacaaacgtactgtaggtactagccactatctacg

SEQ ID NO: 18956 - DNA, 502 bp, Homo sapiens
  misc_feature: GYAE6OF02HE44J.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaagcccctaagctcctgatctatggtgcatccatttgcaaagtggggtcccatcaaggttcagcggcagtggatctgggacagatttcactctcaccatcagcagcctacagcctgaagtattttgactaacttattactgtacaacagtacttaataattacgcgtcttctacgtttcggcggtagggaccaagggtggaagatacgaaacgtactgtcggctgcacctatctcg

SEQ ID NO: 18957 - DNA, 561 bp, Homo sapiens
  misc_feature: GYAE6OF02I5ZAN.4.10.A10.1.454.CMB.1.raw
  modified_base (265)..(265): a, c, t, g, unknown or other
  misc_feature (265)..(265): n is a, c, g, or t
tcagagcactgtagcacgaccggtgctcgatttagcgtcgatctcagggggagtcagtcccagtcaggacacagcatggacatgagggtcccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagcaaaaccagggaaancccctaagctcctgatctatggtgcatccactttgacaaaggtggggtcccatcaaggttcaggcggcagtggatcgtgggacagatttcactctcaccatcagcagcctacagcctagaagtattttagaccttaaactttattactgtaccaaactacgtactttaaataacgttacgacgtaccttctaaccgttttcgggacggtacggggacctaagggtacgggaaggtacttaacgaaaaccggtaacgttaggtacgggaccttacggaccaacccgtattccgttcg

SEQ ID NO: 18958 - DNA, 547 bp, Homo sapiens
  misc_feature: GYAE6OF02JQD9M.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagttcaccatcacttgccgggccagtcagggcattttcagttatttagcctggtatcagcaaaaacaggaaagcccctaagctcctgatctatggtgcatccactttgcaaagtggggtcccagtcaaggttcagcggcagtggatcgtgggacagatttcactctcgaccagttccagtaccacgcccttaacacggtaccctgaaacgtattttacgacctaaacgtttattaactgtacaactagtacttaataattacgcgtctctacgtttcggacgtacgggacctaaggtggagaacgtacgaaacgtaacttaggtcggtactacggactaactacgtcgttacg

SEQ ID NO: 18959 - DNA, 498 bp, Homo sapiens
  misc_feature: GYAE6OF02IQ36Q.4.10.A10.1.454.CMB.1.raw
  modified_base (268)..(268): a, c, t, g, unknown or other
  misc_feature (268)..(268): n is a, c, g, or t
  modified_base (495)..(495): a, c, t, g, unknown or other
  misc_feature (495)..(495): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaancccctaagctcctgatctatggtgcatccatttgcaaagtggggtcccatcaaggttcagcggcagtggatctgggacagatttcactctcaccatcagcagcctacagcctgaagtattttgactaactttattactgtacaacagtcttaaataattacgcgtctcactttcggcggagggaccaaggtggaagatacaaacgtaactgtcggctgacacctatntcg

SEQ ID NO: 18960 - DNA, 529 bp, Homo sapiens
  misc_feature: GYAE6OF02GSTHN.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctacctgatctatggtgcatccactttgctaaagtggggtacccatcaaggttcagcggcagtggatcgtgggacagatttcactctcaccatcagcacgcctacacgcctagaagtattttgactaacttattactgtacaacagtactttaaataattacgcgtacttctacgtttcggacggacgggtaccaagggtgggaagtaactacgaaacggtactaggtagggactaggcctaccgtatctacg

SEQ ID NO: 18961 - DNA, 592 bp, Homo sapiens
  misc_feature: GYAE6OF02HX22Z.4.10.A10.1.454.CMB.1.raw
  modified_base (143)..(143): a, c, t, g, unknown or other
  misc_feature (143)..(143): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatggtnccgatccgagttgacccagtctccatcctcctgtctgcatctataggagacagagtcaccatcacttgccgggccagtcagggcattttcagttatttagcctggtatcagcaaaaaccagggaaancccctaagctcctgatctatggtncatccacttttgactaaagtggggtacccagtcaaggttcagcggcagtggatcgtgggacagatttcactctcacctatcagcagcctanacgcctagaatacttttgactaaactttnttaactgttacaacgtagtaacctttaaataaacgtttacgcgtaccttaccttaaccggttttccgggacgggttaacggggaccctaaaggggtcgggaagtaacttaaccggtaaaaccggtaacgtcgggttacgggaccttagggaccctaacccgttagttaccgtttaccg

SEQ ID NO: 18962 - DNA, 513 bp, Homo sapiens
  misc_feature: GYAE6OF02G9YIJ.4.10.A10.1.454.CMB.1.raw
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaccagggaaagcccctaagctcctgatctatggtgcatccactttgcaaagtggggtcccatcaaggttcagcggcagtggatcgngggacagatttcactctcaccatcagcagcctanacgcctagaagtattttgacctaactttattactntacaactagtacttaaataattacgcgtcctctacgtttcggacgggaggaccgtagggtaggagtatacgaaacgaactggtaggctgaccacctatctcg

SEQ ID NO: 18963 - DNA, 506 bp, Homo sapiens
  misc_feature: GYAE6OF02F1CQX.4.10.A10.1.454.CMB.1.raw
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgccccctaagctcctgatctatggtgcatccactttgacaaaggtggggtcccagtcaaggttcagcggcagtggatcgtgggacagtatttcactctacacatcagcagcctanacgcctagaagtntttgactaactttattactgtacaactagtacttaaataattacgcgtacttcacgtttcggacggaggaccaaggtggagatacaaacgactgtcgctgcacgatctcg

SEQ ID NO: 18964 - DNA, 586 bp, Homo sapiens
  misc_feature: GYAE6OF02GEYOQ.4.10.A10.1.454.CMB.1.raw
  modified_base (271)..(271): a, c, t, g, unknown or other
  misc_feature (271)..(271): n is a, c, g, or t
  modified_base (346)..(346): a, c, t, g, unknown or other
  misc_feature (346)..(346): n is a, c, g, or t
  modified_base (381)..(381): a, c, t, g, unknown or other
  misc_feature (381)..(381): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatcgtataggagacagagtcaccatcacttgccgggccagtcagggcattttcagttatttagcctggtatcagacaaaaaccagggaaacncccctaagcctacctgatctatggtgcatccatttgacaaaggtgggtccatcaaggttcagcggcagtgatcgngggacagatttcactcgtcacatcagcagccctanacgcctagaaacgtactttttacgaccttaaacttttaacgttacttacgtacctaaaaccgtggtaacctttaaattaaacttaccggcgtaccttacctacgttttaccgggaccggtaagggtacctaaggggtcggaaggtaacttaccggaaaacggtacgttaggtacggtcttacggtaccaaccgtattccgttacg

SEQ ID NO: 18965 - DNA, 559 bp, Homo sapiens
  misc_feature: GYAE6OF02G43BD.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcagggcattttcagttatttagcctggtatcagcaaaaaccagggaaagcccctaagcctcctgatctatggtgcatccatttgcaaagtcggggtacccagtcaaggttcaggcggcaggtggatcgtgggacagtatttcactctcaccatcagcagcctaagagcctagaagtatttgactaactttattactgtacaacagtacttaaataatttaccgcgtctacgtacgtttaccgggcggaacgggtacctaaggggtggaaggtaacttaacggaaaaccggtaaccgttaggttacggtacttacggacctaacccgtagttaccctttacgg

SEQ ID NO: 18966 - DNA, 500 bp, Homo sapiens
  misc_feature: GYAE6OF02FHEZY.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaacgcccctaagctcctgatctatggtgcatccactttgcaagtggggtccatcaagttcagcggcagtggatctgggacagtatttcactctcaccatcagcacgcctacacgcctgaagtattttgactaaactttattactgtacaacagtacttaaataacttacgcgtactctactttcggacggagggaccaaggtggaagatacaaacgatagtgctgcaccatctcg

SEQ ID NO: 18967 - DNA, 620 bp, Homo sapiens
  misc_feature: GYAE6OF02J3KWX.4.10.A10.1.454.CMB.1.raw
  modified_base (273)..(273): a, c, t, g, unknown or other
  misc_feature (273)..(273): n is a, c, g, or t
  modified_base (465)..(465): a, c, t, g, unknown or other
  misc_feature (465)..(465): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagtttattagcctggtatcaagacaaaaaccgagggaaacncccctaagcctcctgatctatggtgctactcctacgtttgacctaaaggttcggggtacccagttaccgaaaggtttcgacggccggtctaggttcggaacgtcgtacggggtaactaacggtactttccaaccttcctaccaacctataccgagtccaacggtcccttaacgacgtcctaggaaacgtttntttacgaccttaaactttacttacgtcgtaacaaactcgttaactttaaactaactaccggcttcctactaccggttacggcgggtaacggacctagggtaggaactacacgaaacggtacgtggtaccggctcggtaccaccttagtccttacg

SEQ ID NO: 18968 - DNA, 555 bp, Homo sapiens
  misc_feature: GYAE6OF02HRN6I.4.10.A10.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (398)..(398): a, c, t, g, unknown or other
  misc_feature (398)..(398): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggcattttcagttattagcctggtatcagacaaaaaccgngggaaancccctaagcctacctgatctagtggtgcatccactttgacaaaggtcggggtccatcgaaggttcagcggcagtggatcgtgggacagtattcacttctacaccatcagcacgcctacagcctagaagtntttacgactaactttatactgtacaactagtactttaaagtaacttacgcctacttacgtactttcgggacggggtacgggacctaaggggtggaacgtacgttaaccgaaacggtaacgttggtacggtctacgaccgaacccttagtaccttacg

SEQ ID NO: 18969 - DNA, 546 bp, Homo sapiens
  misc_feature: GYAE6OF02FYS81.4.10.A10.1.454.CMB.1.raw
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (424)..(424): a, c, t, g, unknown or other
  misc_feature (424)..(424): n is a, c, g, or t
tcagagcactgtagcacgaccggtgctcgatttagcgtcgatctcgagggggagtcacgtcccagtcaggacacagcatggacatgagggtccccgctcagctcctggggctcctgctgctctggctcccaggtgcctagatgtgcctaagtccagttgacccagtctaccatcctccctgtctgcaggtctataggagacaggagtcacatcacttgccgggccagtcagggcagttttcagttatttagcctggtatcagcaaaaccngggaaacncccctaagctcctgatctatggtgcatccatttgctaaagtgggtccagtcgaaggttcagcggcagtggatcgtgggacaggtatttcactctcaccatcagcagcctaacacgcctagaagtattttcgactaacttattactntacaactagtacttaataattacgcgtacttctacgtttcggacggtagggaccgaagggtaggaagtaagtacgaaacgtaacgtaggtacggacgttacgacctaaccgtattcgtacgg

SEQ ID NO: 18970 - DNA, 499 bp, Homo sapiens
  misc_feature: GYAE6OF02FHXOF.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcaggggcattttcagttatttagcctggtatcagcaaaaaccagggaaagccccctaagctcctgatctatggtgcatccactttgcaaagtggggtccatcaaggttcagcggcagtggatctgggacagatttcactctcaccatcagcagcctacacgcctgaagtattttgctaacttattactgtacaacagactttaataacttacgcgtctctactttcgggcggtagggaccgaaggtggaagatacaaacgactgtggctgcaccatctcg

SEQ ID NO: 18971 - DNA, 607 bp, Homo sapiens
  misc_feature: GYAE6OF02GF2RO.4.10.A10.1.454.CMB.1.raw
  modified_base (269)..(269): a, c, t, g, unknown or other
  misc_feature (269)..(269): n is a, c, g, or t
  modified_base (379)..(379): a, c, t, g, unknown or other
  misc_feature (379)..(379): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaacagggaaacncccctaagctctgatctatggtgcatccatttgacaaggtggggtcccatcgaaggttcaggcggctagtggactcgtagggacctagtatttcgacctctacaccgtanccgagccagtccctacgacgtccctagaacgttattttacgacctttaaacgttactttactacgttaccaaactagtactttaaataacgtttacgacgttcttaccgtaccgttttacggggaccggtaagggtacccgtaagggtacgggtaacggtaacttaaccgaaaccggttacgttagggttacgggccttacgggcctaacccgtagttaccgtttacg

SEQ ID NO: 18972 - DNA, 529 bp, Homo sapiens
  misc_feature: GYAE6OF02HNM72.4.10.A10.1.454.CMB.1.raw
  modified_base (262)..(262): a, c, t, g, unknown or other
  misc_feature (262)..(262): n is a, c, g, or t
  modified_base (422)..(422): a, c, t, g, unknown or other
  misc_feature (422)..(422): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgctgggccagtcagggcattttcagttatttagcctggtatcagacaaaaaccngggaaacgcccctaagctcctgatctatggtgcatccactttgactaaaggtcggggtaccatcgaaggttcaggcggcaggtggatcgtgggacagtatttcactctcaccatcagcacgcctacagcctagaagtattttagacttaacttattactnttacaacagtacttaaataattacgcgtctactacgtttcggacggtacggaccgtagggtaggaagactacgaaaccgtagtcgtacggctaggactaccgattcg

SEQ ID NO: 18973 - DNA, 554 bp, Homo sapiens
  misc_feature: GYAE6OF02IM9XT.4.10.A10.1.454.CMB.1.raw
  modified_base (297)..(297): a, c, t, g, unknown or other
  misc_feature (297)..(297): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagtttattagcctggtatcagacaaaaaccgagggaaacgcccctaagctcctgactctatggtncatccactttgactaaaggtcggggtccagtcgaaggttcaggcggcagtgatcgtgggacagtattcactctcaccatcagcagcctanacgcctagaatntttcgactaactttatactgtacaacagtactttaaatacgttacgcgtacttaccgtacgtttacgggacgggtaacgggaccgtaaggggttcggaagtaactacgaaaacgtacgttaggtacggacttacgaacccgtattcgtagttacc

SEQ ID NO: 18974 - DNA, 500 bp, Homo sapiens
  misc_feature: GYAE6OF02FNUFN.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaacgcccctaagctcctgatctatggtgcatccactttgcaaagtggggtcccatcaaggttcagcggcagtggatctgggacagatttcactctcaccatcagcagcctacacgcctagaagtattttgactaacttattactgtacaacagtacttaataattacgcgtctctacgtttcggcggtagggaccaaggtggaagatacgaaacgactgtggctgacacatctcg

SEQ ID NO: 18975 - DNA, 578 bp, Homo sapiens
  misc_feature: GYAE6OF02HVVCS.4.10.A10.1.454.CMB.1.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggccagtcagggcattttcagttatttagcctggtatcagacaaaaacagggaaancccctaagctcctgatctatggtncatcctacttttgactaaaggtcggggtaccatacgaaggttcaaggcggcaggtggatcgtagggacagtactttcactctacaccatcagcagcctacgagcctagaagtattttcgactaactttacttaactgtaacaactagtactttaaataacgttacgcgtcttaccgtacgtttacgggacgggtaacgggaccgtaagggtcggaaagtacgttaaccgaaaacggtaacgttcgggtacgggtactaaccggcctaaccgtacgttcgttaccgg

SEQ ID NO: 18976 - DNA, 627 bp, Homo sapiens
  misc_feature: GYAE6OF02I572Q.4.10.A10.1.454.CMB.1.raw
  modified_base (311)..(311): a, c, t, g, unknown or other
  misc_feature (311)..(311): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccatcctccctgtctgcatctataggagacagagtcaccatcacttggccggccagtcagggctactttctagttattacgcctggtactcacgaacaaaaaccgagggaaaccgtacccctaagcctccgtagactcgtagtggtcnctactcctacgttgacgtaaggtcgggtacctagtacgtaaggttcgacggcggacgtaggtggactcgtagggactagtacttaccgacttctaccacctactacaacgtactacgtacctacgacgtaccttagtaagttagtttacgacttaaactttagttacctacgtaactaaacgtagttaacttaaattaacttaccgcttactacgtacgttaccgggacggtaagggtaaccgtagggtaggaaacgtacgtaacgaaaacgtacgttggtacggtctacggtaacctaccgttattacgttacgg

SEQ ID NO: 18977 - DNA, 513 bp, Homo sapiens
  misc_feature: GYAE6OF02GJCHZ.4.10.A10.1.454.CMB.1.raw
  modified_base (496)..(496): a, c, t, g, unknown or other
  misc_feature (496)..(496): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgcccctaagctcctgatctatggtgcatccactttgacaaggtggggtcccatcaaggttcagcggcagtggatcgtgggacagtatttcactctcacatcagcagccctacacgcctagaagtattttcgactaactttattacctgtacaactagtacttaaataattacgcgtactctacgtttcgggacggaggaccaaggtggaagatacgaaacgtacgtgnggctgccactatctacg

SEQ ID NO: 18978 - DNA, 608 bp, Homo sapiens
  misc_feature: GYAE6OF02H7Y6S.4.10.A10.1.454.CMB.1.raw
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcgagggctattttcagttattagcctggtatcgaagacaaaaacgagggaaacgcccctaagctacctgatctagtggtnctactcctactttcgactaaaggtcgggtacccagtactaaggtcaggcggnaggtgatcgtgggacagtacttcactcgtacactatcaagtccagcctacacgtacctaggtaagttattttacgaccttaatttactttactagtaccaaatacgtaactttaaataacgttaccgtcgtacttaccgttaacggtttccgggacgggtaacgggtacccgtaagggtacggaaacgtaacgttaaccgaaaaccggttaacgttcggtacggtacctacggtacccaccgttacttacgttaccg

SEQ ID NO: 18979 - DNA, 542 bp, Homo sapiens
  misc_feature: GYAE6OF02G7KP9.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccaggaaagcccctaaagctcctgatctatggtgcatccactttgactaaagtggggtcccatcaaggttcagcggcaggtggatcgtgggacagatttcactctacaccatcagcacgcctaacagcctagaagtatttgactaacttattactagtacaactagtacttaataattacgcgtacttaccgtacgtttcgggacggtacgggtacccgtaagggtaggaacgtaataacgaaaacgtaacgttggtacggtctagacccaacgtactcttacg

SEQ ID NO: 18980 - DNA, 671 bp, Homo sapiens
  misc_feature: GYAE6OF02HQ6JV.4.10.A10.1.454.CMB.1.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccatccctccctgtctgcatctataggagacagagtcaccatcacttggcccgggccagtcgagggctattttcagtttattagcctggtatcagacaaaaacgagggaacnccctaagctcctagatctagtggtncactcctactttcgacgtaaacggtcggggtaccctaagtacgtaaaggttcacggccggactagggtcggaagttcggtaggggaacctaaggtactttaccacttcctaccgaaccctactaccaacgccaacggtaccctaacgacgtaccttaggtaaagttacgtttttacggaacctttaaacttttaactttacgtacgttaaccaaacgtaacgttaaccttttaaactaaacgtttaccgacgttaccttaccgtaaccggtttccgggacgggtaacggggtaccgtaagggtaggaacggtaactaacgaaaccggtaacgtggtacggtacgtacggaccctaaccgtattccgttacg

SEQ ID NO: 18981 - DNA, 548 bp, Homo sapiens
  misc_feature: GYAE6OF02HYIA7.4.10.A10.1.454.CMB.1.raw
  modified_base (376)..(376): a, c, t, g, unknown or other
  misc_feature (376)..(376): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaagcccctaagctcctgatctatggtgcatccactttgcaaagtggggtcccatcaaggttcagcggcagtggatcgtgggacagtattcatctcacatcagcagcctanagcctgaagtattttgactaactttattactgtaccaaatagactttaaataagttaccgcgtactactacgtttcgggacggtaacggggtacctaagggttacggaagtaactacgaaaaccggtacgttaggtacggtaccttaggaccctaaccgtagtaccgttacg

SEQ ID NO: 18982 - DNA, 552 bp, Homo sapiens
  misc_feature: GYAE6OF02GQHDO.4.10.A10.1.454.CMB.1.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (422)..(422): a, c, t, g, unknown or other
  misc_feature (422)..(422): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagcaaaaaccagggaacncccctaagctcctgatctagtggtncatccactttgactaaaggtggggtacccagtcgaaggttcaggcggacagtggatcgtagggacagtactttcactctcacctatcagcacgcctacacgtcctagaagttattttgacttaactttnttactgtacaactgtactttaataacttacgacctcttacgtaccgtttacgggacgggtaagggaccgtaagggtaggaacgtaacttacgaaaccgtacgttggtacggactggaccactatcgttcg

SEQ ID NO: 18983 - DNA, 562 bp, Homo sapiens
  misc_feature: GYAE6OF02FFDL6.4.10.A10.1.454.CMB.1.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
tcagagcactgtagcacgaccggtgctcgatttagcgtcgatctcagggggagtcagtcccagtcaggacacagcatggacatgagggtcccgctcagctcctgggctcctgctgctctggctcccaggtgccagatgtgccatccagttgacccagtctccatcctccctgtctgcatctataggagacagacgtcaccatcacttcgccgggcagtcgagggctatttcagttattagcctggtatcacgacaaaacgnggaacncccctaagcctactgactctagtggtcnctactcctactttgacgtaaggtcgggtaccagtcaggttcagcgactagtcgactcgtagggactagtacttcactcacacactcagcacgtcctacgacgtacctagaacgtntttacgacttaacttactacgtagtaccaacgtacgtactttaaagtacgttacgcgttactacgtacggtttcggacgggtacgtacgaaggtcggaacgtactaccgtaaacgtcgtaggtacgtacgtacgactaccgtagtcgttacg

SEQ ID NO: 18984 - DNA, 578 bp, Homo sapiens
  misc_feature: GYAE6OF02IZGMT.4.10.A10.1.454.CMB.1.raw
  modified_base (269)..(269): a, c, t, g, unknown or other
  misc_feature (269)..(269): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacncccctaagctccctagatctatggtgctactccactttgacgaaaggtcggggtacccatcgaaggttcagcggcaggtggatcgtagggacagtatttcactctcaccatcagcagcctacagcctagaagtatttgactaacttattactgtacaactagtacttaaataacttacgccgtacttaccgtacgtttaccgggacggtaacggggtacccgtaaggggtagggaaacggtacgtaaccgaaaaccggtaaccgttgggtacgggtccttacggacctaacccgtagttcccgttacgg

SEQ ID NO: 18985 - DNA, 567 bp, Homo sapiens
  misc_feature: GYAE6OF02F8G89.4.10.A10.1.454.CMB.1.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (425)..(425): a, c, t, g, unknown or other
  misc_feature (425)..(425): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaacgngggaaacncccctaagcctacctgatctagtggtcgcactccacttttagacgaaaggttcggggtacccagttacgaaggtttcaggcggtacaggtcggatcgtagggaactaggtatttcgactcgtacaccatcagcagccctagagtacctagaagtntttacgacttaaacttattactgtacaacgtagtacttaaataacgttacgacgtctacgtacgtttcggacgggtaggaccgaaggtcggaagaactacgaaacggtactaggtcgtcctacggacctaacctagtctacg

SEQ ID NO: 18986 - DNA, 538 bp, Homo sapiens
  misc_feature: GYAE6OF02FW28R.4.10.A10.1.454.CMB.1.raw
  modified_base (269)..(269): a, c, t, g, unknown or other
  misc_feature (269)..(269): n is a, c, g, or t
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcagggctattttcagttatttagcctggtatcagacaaaaacagggaaacncccctaagctacctgatctatggtgcatccatttgactaaaggtggggtcccatcaaggttcagcggcaggtgatcgtagggacagtattacactctcaccatcagcagcctacacgacctagaagtntttcgactaacttattactgtcaaactgtaacttaataattacgctacttactacgtttcggacggtaggaccgtaaggtagggtaanaacttacgaaaaccgacgttggtacggacttggaacctaccgtattcgttacg

SEQ ID NO: 18987 - DNA, 508 bp, Homo sapiens
  misc_feature: GYAE6OF02I8GNN.4.10.A10.1.454.CMB.1.raw
  modified_base (376)..(376): a, c, t, g, unknown or other
  misc_feature (376)..(376): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaccgagggaaacgcccctaagctcctgatctatggtgcatccactttgacaagtggggtcccatcaaggttcagcggcagtgatcgtgggacagattcactctcaccatcagcagcctanagcctagaagtatttgactaacttattactgtacaactagtacttaataattacgcgtctctacgtttcgggcggtagggacaggtcggaagtactacgaaacgtactggtacggtctagaccactatctcg

SEQ ID NO: 18988 - DNA, 654 bp, Homo sapiens
  misc_feature: GYAE6OF02HZ1E6.4.10.A10.1.454.CMB.1.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttggccgggcagtcagggctattttcagtttattagcctggtatcagacaaaaaccgagggaaacncccctaagcctcctagattctatggtgcactcctacttttacgacgaaacggtcggggtacccagtacgtaaaggttcaggcggacgaggtggactcgtagggactagtactttcacttctacacatcacgcacncctaanacgcctagaagttacttttacgacttaacgtttaacttacgtacgtacctaacgtaagttaactttaaattaaacgtttaccggaccgttacctttaacccgtaccggttttaccggggaaccggggtaaccggggttaacccgaagggggttacgggaacgttaaccggttaacccgtaaaaccggtaaccgttagggtacgggtccttacggacccttaaccgtacttaccgtttacgg

SEQ ID NO: 18989 - DNA, 576 bp, Homo sapiens
  misc_feature: GYAE6OF02G2T0P.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccgagggaaacgcccctaagcctacctgatctatggtgctatctactttgactaaaggtcggggtacccatcgaaggttcaggcggcaggtggatcgtgggacagtatttcactctcaccatcagcacgcctaacacgcctaggaagtattttcgactaacttattactgtactaaacagtacttaaataattaccgcgtacttactacgtttccgggacgggtacgggacctaagggtacggaacgtaacgttaaccgaaaacggtaaccgttggtacgggtaccttacggacccgtaacctacgttccttacgg

SEQ ID NO: 18990 - DNA, 627 bp, Homo sapiens
  misc_feature: GYAE6OF02JG9U9.4.10.A10.1.454.CMB.1.raw
  modified_base (192)..(192): a, c, t, g, unknown or other
  misc_feature (192)..(192): n is a, c, g, or t
  modified_base (265)..(265): a, c, t, g, unknown or other
  misc_feature (265)..(265): n is a, c, g, or t
tcagagcactgtagcacgaccggtgctcgatttagcgtcgatctcagggggaggtcagtcccagtcaggacacagcatggacatgagggtcccgctcagctcctgggctcctgctgctctggctcccaggtgccagatgtgccatccagttgacccagtctccatcctcctgtctgccatctataggagacngagtcaccatcacttgccggccagtcagggctattttcagttattagcctggtatcagacaaaacagggaaancccctaagcctctgatctaatggtgcatccactttgacgaaagttcggggtacccatacgaacggtttcaggtcggctacggttgacgtccgtggggaacctagtatttaccacttccgtactaacctataccgagtacacggtccttacgacgtacccgtagtaaacggttattttacgacctaactttaactttacgtacgtaccttaaacacggttaactttaaacggtaacttacggaccgttacttcgttaaccgtttccgggagggttaaccggacgtaacgggtcggtaacggtaactacggtaaaaccgtaacgttcgggttacgcgtaccgtaccaacggttactccgttacg

SEQ ID NO: 18991 - DNA, 666 bp, Homo sapiens
  misc_feature: GYAE6OF02G7ZSW.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggctattttcagttatttagccttggtatcaagacaaaaaccgagggaaacgcccctaaagcctaccgtgatctatggtgctatcctactttgactaaaggttcggggtaccctagtacgtaaggttcacggcggctaggtggatcgtagggactagtactttcgacttcgtcacctatcacgcacggacccttacgacgtaccgtaggaaacgttacgttttacgaacccgttaaacttttacttaaccgttacgtacctaaacgtaacgttaacctttaaagtttaaacgttaccgtaccgttaccttaccgtaaccggttttccgggacgggtaacggggtaccctaaggggttacggtaaacggtaacgttaaaccgaaaacggttaaccgttaggtacggtaccgtacgtaacccgtaaccgttacgttccttaccgg

SEQ ID NO: 18992 - DNA, 571 bp, Homo sapiens
  misc_feature: GYAE6OF02FPIMK.4.10.A10.1.454.CMB.1.raw
  modified_base (366)..(366): a, c, t, g, unknown or other
  misc_feature (366)..(366): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaacgcccctaagctcctgatctatggtgcatccactttgacaaaggtggggtcccatcaaggttcagcggcaggtggatcgtgggacagtatttcactcncacatcagcacgcctacacgtcctagaacgttattttacgcgtaactttaattacgttgtaccaactagtactttaaattaattacggctacttactacgtttcgggaccgggtagggacccgaaggggttacggaagtaacgtaaccgaaaaccggtaaccgttaggttacggcttacggaccgtaacccgtattccgttacgg

SEQ ID NO: 18993 - DNA, 636 bp, Homo sapiens
  misc_feature: GYAE6OF02JYTVJ.4.10.A10.1.454.CMB.1.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcgccggccagtcagggctattttcagttattagcctggtatcagacaaaacgaggaaacnccctaagctctgatctatggtnacactcctattcgacgtaaggtcggtacctatacgaaggttcacgcggcagtcggatcgtaggactagtattcgacttcgtaccaaccgtagtcgagtaccacggtaccctaacgcgtaccgtagtaaacgttacgttttacgaccttaaacgtttaacttacgtacgttaaaccctaaacggtaactttaaccgtttaaaactttaaacggtttacccgaccgtttacttacccgttacggttttaccggggaacgggtaaccggggtaacgtacggggttaggaacgttaactaaccgtaaaccgtaggttacgtacggactacgaccaccgtattccgtacg

SEQ ID NO: 18994 - DNA, 662 bp, Homo sapiens
  misc_feature: GYAE6OF02G31KD.4.10.A10.1.454.CMB.1.raw
  modified_base (190)..(190): a, c, t, g, unknown or other
  misc_feature (190)..(190): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttcggccggcagtcgagggctattttcagtttattagcctggtatcagacaaaacaggaaacnccctaagctacctgatctagtgggtcncactcctactttgacgaaacggttcggggtacccagtacgaaacggtttcaggcggtacaggtaggacgtacgtaggggacctaaggtactttccaacttctacgaaccctatccgagtcacgtaccctaacgacgtcctaaggtaagttacgttttacgaccttaaactttattacgttacgtaactaaacgtagtaaacctttaaattaacttaaccgtacgttaccgttaccgttaaccgtttacgggggaacgggtaaccgggtaaccgtaaggggttacggtaacggtaacgttaaaccggaaaaccggttaaccgttaggtacgggtaccttaggacccctacgttacgttctttaccgg

SEQ ID NO: 18995 - DNA, 628 bp, Homo sapiens
  misc_feature: GYAE6OF02G0YKI.4.10.A10.1.454.CMB.1.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggccagtcgagggctattttcagttatttagcctggtatcagcaaaacagggaaancccctaagctcctgatctgtggtgcatccactttgcaaaggtcggggtcccagtcaaggttcagcggcaggtggatcgtgggactagtactttcgactctcacntcagccagcctanacgccctagaagttacttttgaccttaaactttattaaccgtgtacctaaaactagttaaccttttaaattaaaccgttccggtacccgtaccgttacctaacccggttttaccggggacccggggttaaacggggacccgtaaaagggggttcggtaaacgggaacttaaccgggaaaaaccgtaaccggttggttaccgggtaccgttcggaacccgtaaccctagttacccgtttaccgg

SEQ ID NO: 18996 - DNA, 492 bp, Homo sapiens
  misc_feature: GYAE6OF02FQN2M.4.10.A10.1.454.CMB.1.raw
  modified_base (269)..(269): a, c, t, g, unknown or other
  misc_feature (269)..(269): n is a, c, g, or t
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacncccctaagcctcctgatctatggtgcatccactttgactaagtggggtcccatcaagttcagcgnagtgatcgtggacagtatttcactctcaccatcagcagcctacacgcctagaagtntttgactaacttattactgtacaacagtacttaaatattacgctactctacgtttggcgaggaccaggtgaagatacaaacgtacngtgctgcactatntcg

SEQ ID NO: 18997 - DNA, 554 bp, Homo sapiens
  misc_feature: GYAE6OF02I0CFT.4.10.A10.1.454.CMB.1.raw
  modified_base (190)..(190): a, c, t, g, unknown or other
  misc_feature (190)..(190): n is a, c, g, or t
  modified_base (514)..(514): a, c, t, g, unknown or other
  misc_feature (514)..(514): n is a, c, g, or t
  modified_base (548)..(548): a, c, t, g, unknown or other
  misc_feature (548)..(548): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccggccagtcagggctatttcagttattagcctggtatcagacaaaaccgagggaaacgcccctaagctccgtagatctagtggtgctatcctactttgacgtaaaggtcggggtaccctaagtcgaaaggttcgaacggcggcgtaggtggatcgtaggggactagtacttcactctcaacctatacagcacgacctacgacgtactagaacgttatttacgacttaacttattactgtacaactatacttaaataacttacgcgtacttactacgttcgggacggaggtaccgtaggtggaanacgtaacgaaacgtacgtgtaggctgcctaactntcgtcg

SEQ ID NO: 18998 - DNA, 532 bp, Homo sapiens
  misc_feature: GYAE6OF02IFXWW.4.10.A10.1.454.CMB.1.raw
  modified_base (295)..(295): a, c, t, g, unknown or other
  misc_feature (295)..(295): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcgccgggccagtcagggcattttcagttattagcctggtatcagacaaaaaccagggaaacgcccctaagctcctagatctatggtnctatcctactttgacaaggtcggggtcccatcgtaaggttcaggcggcaggtggatcgtgggacagtattcactctcacatcagcagcctacacgcctagaagtattttcgactaacttattactgtacaactagtacttaataacttacgctacttctacgtttcgggacggtacggaccgaaggtacggagaacgtacgaaacgtacgtggtacgctacgaccacctactcttcg

SEQ ID NO: 18999 - DNA, 526 bp, Homo sapiens
  misc_feature: GYAE6OF02JBK26.4.10.A10.1.454.CMB.1.raw
  modified_base (270)..(270): a, c, t, g, unknown or other
  misc_feature (270)..(270): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaacncccctaagctcctgatctatggtgcatccactttgactaaaggtcggggtacccatcaaggttcaaggcggcaggtggatcgtaggggactagtactttcactctcaccatcagcagcctacacgtcctagaagtattttgactaacttattactgtaccaacagtacttaaataacttacgctacttctacgtttcggacggtaggaccaagggtgaagatacgaaacgtagtgtacggctgaccactatctacg

SEQ ID NO: 19000 - DNA, 572 bp, Homo sapiens
  misc_feature: GYAE6OF02IOFH4.4.10.A10.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctcctgtctgcatctgtgganacagagtcatcatctctgccgggnaagtcagagtgttagttatttaatttaattggtatctagttacaaaccgaggaacacccctaagctcctagatctatgtctgcatcctaagtttaacgaaaggttcgggtacccatacaagtattcgaggtgacgaggttggtattcgtagggactaggttactttaccgacttcctacacctaatacgtagtacgttactaaccgaacttgaaagttatttagacttaactttactacttagtactaagagtacgttaacacctaccctccgtactcgttaccgttcggacggtacggacgtagggtgacggtaactacgaaacgtcgtgtaacggctcgaccacgtacttctgttcc

SEQ ID NO: 19001 - DNA, 555 bp, Homo sapiens
  misc_feature: GYAE6OF02G6R2N.4.10.A10.1.454.CMB.1.raw
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatcctccctgtctgcatctataggagacagagtcaccatcacttgccgggcagtcagggctatttcagttattagcctggtatcagacaaaaccagggaaacgccctaagctcctgatctagtggtgctatcctactttgactaaggtcggggtcccagtcgtaaggttcagcggcagtgatcgtagggacagtattcactctcacatcagcacgcctacacgtcctagtaagtattttacgacttaaacttattactcgtacaactagtacttaaatacttaacgtcgtacttaccgtacgtttccgggacggtacgggaccgtagggtacggaacggtacttaaccgaaacggtaacgtagtacggtacctagaccaaccgtatacgtcg

SEQ ID NO: 19002 - DNA, 566 bp, Homo sapiens
  misc_feature: GYAE6OF02FVA13.4.10.A10.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccngggaaancccctaagctacctgatctagtggtnctatccatttgactaaagtcgggtccatcaaggttcagcgcagtggatcgtgggactagtactttcactctcaccatcagcagcctacgagcctagaatgttttagacttaaacttattaactgtacaactatactttaaataactttacgacgttcttacctacgttttccgggacggtaacgggacctaaggggtacggtaaggtaacgttaaccgaaaaacgtacgttcggtacgggccttacggaccctaacctacgttaccgttacg

SEQ ID NO: 19003 - DNA, 598 bp, Homo sapiens
  misc_feature: GYAE6OF02GJYO5.4.10.A10.1.454.CMB.1.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagcctggtatcagacaaaaaccgaggaacncccctaagctacctgacttctagtggtncactcctactttgacgtaaggtcgggtacccagtcgtaaggtcaggcgcaggtgatcgtaggactgtactttccacttcacaccatcacgcacgcctaacgacgtcctagagttattttcgacttaacgtttataactcgtaccaacgtagtaacctttaaagtacttaccgtctaccgttaccgtacggtttcgggaccgggtaagggtacccggtaagggtaggtaacgtaacgttaaccgtaaaaccggtacgttagggtacggtccgtacgaccgtacccgttatttccggttaccg

SEQ ID NO: 19004 - DNA, 500 bp, Homo sapiens
  misc_feature: GYAE6OF02GV62L.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaaagctcctgatctatggtgcatccactttgactaaagtggggtcccatcaaggttcagcggcagtggatcgtgggacagatttcactctcaccatcagcagcctacagcctagaagtatttgactaactttattactgtacaacagtacttaaataattacgctcttcacgttcggacggaggaccaaggtggagactacaaacgactgtcggctgcactatctcg

SEQ ID NO: 19005 - DNA, 572 bp, Homo sapiens
  misc_feature: GYAE6OF02HNRCK.4.10.A10.1.454.CMB.1.raw
  modified_base (190)..(190): a, c, t, g, unknown or other
  misc_feature (190)..(190): n is a, c, g, or t
  modified_base (296)..(296): a, c, t, g, unknown or other
  misc_feature (296)..(296): n is a, c, g, or t
  modified_base (397)..(397): a, c, t, g, unknown or other
  misc_feature (397)..(397): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggccagtcagggctattttcagttatttagcctggtatcagacaaaaaccgagggaaacgcccctaagctcctgatctatggtncaatcctacttgacaaggtcgggtacccagttcaaggttcagcggcagtggatcgtgggacagtatttcacttctacacctatccgaagtcagaccctaanacgtaccctaggaactagttttacgactaactttatactgtacaatacgtacttaactaattacggactcctacgtacgttcggacgggtacggacctaagggtacggaacgtaacgtacgaaaacggttaccgtaggtacgtaccgtacggtacctaaccgtacttcttaccgg

SEQ ID NO: 19006 - DNA, 584 bp, Homo sapiens
  misc_feature: GYAE6OF02H6CAC.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcgagggctattttcagtttatttagcctggtatcaagacaaaaaccgagggaaacgccctaaagcctacctagatctaagtcggtgctactcctactttcgactaaaggtcggggtacccagtacgtaaggttcaggtcggacaggtaggtactcgtgggaactagtacgtttcacttcctacacatcgaagtacgtactaactaactagaattattttacgaacttaactttactaacttcgtaactaacgagtaacgttacgacctacccctcgtactctacgttcggacggtaacggaccgaaggtcgagacgtaacgaaaccgtagtcggtacgcgtacgacctactatcgtcgtcttacc

SEQ ID NO: 19007 - DNA, 687 bp, Homo sapiens
  misc_feature: GYAE6OF02INHG5.4.10.A10.1.454.CMB.1.raw
  modified_base (273)..(273): a, c, t, g, unknown or other
  misc_feature (273)..(273): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcgccgggccagtcgagggctattttcagtttatttagcctggtatcagacaaaacgagggaaacnccctaagctctgattcgtagtggtgcatcctacgtttgacgtaaaggttcgggggtaccctagtaccgtaaaggtttccgaaggtcgggtaccgtaagggttggtaacgttcggtaggggaacgtaacggttaacttttaccgacctttccgtaccaaccctacgttaccgaacgtaccaacgtaccccttaacgacggtacccttaaggtaaacgtttagtttttacgaacctttaaactttaactttaccgtacgttacctaaacgtagttaacctttaaattaaccgttaacgtaccgtaccttaccgttaccggttttaccggggacgggtaacgggtaccgtaagggttaggaacgtaacgtaacgaaacgtacgtggtacggtcgtacgaccacgtacgttcgttacg

SEQ ID NO: 19008 - DNA, 559 bp, Homo sapiens
  misc_feature: GYAE6OF02GO5R1.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcggccgggccagtcagggctattttcagttattagctggtatcagacaaaaaccgagggaaacgcccctaagcctcctgatctagtggtgcatcctactttgacgtaaacggtcgggtacccagtaccgtaaggttcaggtcggctaggtggatcgtagggacagtacttcactctacactatcacgcacgcctacgacgtacctagtaacgttatttcgacttaaactttacttactagtacaactattaacttaaatacttacgctactacctacgttcggacgggtacgggactaagggtcgaagtaactaacgaaacgtacgtgtacggctagcctacctattctcg

SEQ ID NO: 19009 - DNA, 566 bp, Homo sapiens
  misc_feature: GYAE6OF02GXL3O.4.10.A10.1.454.CMB.1.raw
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttcggccgggccagtcagggtctattttcagtttattagcctggtatcagacaaaaacgagggaaacgcccctaagcctactgatctagtggtgactatccactttgacaaaggtcggggtaccagtacaaggttcagtcggnagtggatcgtagggactagtattcactctcacatcagcacgcctagacgctagaattatttgactaaactttnttactgtacaacgtagtactttaaagtaacttacgcgtcttacgtacgtttacgggacgggtaacggaccgtaagggtcggaacgtaactacggtaaaaccgtacgttagggtacgtacgtcgaacgacctagtccgttacgg

SEQ ID NO: 19010 - DNA, 561 bp, Homo sapiens
  misc_feature: GYAE6OF02IQFVR.4.10.A10.1.454.CMB.1.raw
  modified_base (299)..(299): a, c, t, g, unknown or other
  misc_feature (299)..(299): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagtttattagcctggtatcagacaaaaaccgagggaaacgcccctaagctacctagatctagtggtnctactcctactttgacgtaaaggtcggggtaccagtcgaaggttcaggcggcagtgggatcgtagggacagtactttcacttctacacactacagcacgtcctaagacgacctagaagttatttcgacttaactttattactagtactaacgaacttactttaaatattaccgcgtacttacgtacgtttcggacggtaggaccgtaggtacggaagtaacacgtaaacgacgtggtacgtacgtgacctactattcgtacg

SEQ ID NO: 19011 - DNA, 554 bp, Homo sapiens
  misc_feature: GYAE6OF02JGI0B.4.10.A10.1.454.CMB.1.raw
  modified_base (342)..(342): a, c, t, g, unknown or other
  misc_feature (342)..(342): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccgagggaaacgcccctaagctcctgatctatggtgcatcctactttgactaaaggtcggggtcccagtcgaaggttcagcggnaggtggatcgtgggacagtactttcactctcaccatcagcacgcctacagtcctagaagttatttagacttaactttacttactgtaccaactagtacttaaatacttacgcgtactacgtacgtttacgggacggtacgggtaccgaagggtcggaacgtactaacgaaacgtaacgtggtacggcttacgactaccgtagttccgttacg

SEQ ID NO: 19012 - DNA, 585 bp, Homo sapiens
  misc_feature: GYAE6OF02JYQW7.4.10.A10.1.454.CMB.1.raw
  modified_base (240)..(240): a, c, t, g, unknown or other
  misc_feature (240)..(240): n is a, c, g, or t
  modified_base (279)..(279): a, c, t, g, unknown or other
  misc_feature (279)..(279): n is a, c, g, or t
  modified_base (498)..(498): a, c, t, g, unknown or other
  misc_feature (498)..(498): n is a, c, g, or t
  modified_base (541)..(541): a, c, t, g, unknown or other
  misc_feature (541)..(541): n is a, c, g, or t
  modified_base (569)..(569): a, c, t, g, unknown or other
  misc_feature (569)..(569): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttcgacccagtcctccatccctccctgtctgcatctatagagacagagtcacatcacttcgccgggcagtcgagggctatttcagtttntttagcctggtactcagaccaaaaaccgtaggggaaacncccgtaagctacctgatctatggtcgcacgtcctactttgacgtaaggtcggggtccagtacgtaaggttcaacgggcgactaggtaggtactcgtagggaacagttacgtttaccacgttctacgaacctactcgaacgcgacgcctacgacgccttaggtaaacttgttttacacttaactttataactgtaaccaagtcttacttaataacgttcncgtacttacgacgtttacggacgggtacgacgtaggtacgganaataaccgaaacgttagtggacgtacgnaccctactgtacgttc

SEQ ID NO: 19013 - DNA, 560 bp, Homo sapiens
  misc_feature: GYAE6OF02F6T4H.4.10.A10.1.454.CMB.1.raw
  modified_base (263)..(263): a, c, t, g, unknown or other
  misc_feature (263)..(263): n is a, c, g, or t
  modified_base (373)..(373): a, c, t, g, unknown or other
  misc_feature (373)..(373): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccngggaaacgcccctaagctctgatctatggtgcatccatttgacaaagtcggggtcccatcaaggttcagcgcagtggatcgtgggacagtatttcactctcactatcgancagtccctacacgtcctagaaacgttatttagactaacgtttattacctgtacaactataactttaaataacgtttacgacctactactacgttttccgggacggtaacgggacctaagggtacggtaacgaattaaccgaaaaccggtaacgttggtacggacttacgaccaacctagtcttacgg

SEQ ID NO: 19014 - DNA, 520 bp, Homo sapiens
  misc_feature: GYAE6OF02G75B0.4.10.A10.1.454.CMB.1.raw
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagagcactgtagcacgaccggtgctcgatttagcgtcgatctcaggggagtcagtcccagtcaggacacagcatggacatgagggtccccgctcagctcctgggctcctgctgctctggctcccaggtgccagatgtcgccatccagttcgacccagtctcatcctccctgtctgcatctanagganacagagtcaccatcacttggccggccagtcagggctaattttcagttactttagcctgtatcagacaaaaacnggaaacncccctaagcnctgattcatgtncatccatttganaacggtggtcccatccaaggttcagccggataggtgatcgtggaacngtattccganctancgtancgancgactcacngtactagagttattcgacttaattntacgntacaagtnttaactataaacgtcgcttacgtcttacgtcgacggacgtactaagggtcgaaatcctaacgaaagttaccgtgtgtccgacgtactacgtactggttac

SEQ ID NO: 19015 - DNA, 562 bp, Homo sapiens
  misc_feature: GYAE6OF02HB2GD.4.10.A10.1.454.CMB.1.raw
  modified_base (133)..(133): a, c, t, g, unknown or other
  misc_feature (133)..(133): n is a, c, g, or t
  modified_base (189)..(189): a, c, t, g, unknown or other
  misc_feature (189)..(189): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctccaggtnccagatgtgccatccagttgacccagtctccatcctcctgtctgcatctatagganacagagtcacatcacttgccggcagtcagggctagttttcagttacttagcctggtatacacgtaccaaaacgagggaacncccctaagcctacctgatctatggtncactccacgtttgactaaaggtcggggtacccagtcgaagttcaggcggtacgagttgatcgtaggactagcttcactctacactntacagcacgcctacacgctagaatntttacgactaacgttacttactagtactaactaggtactttaagtaacttagccttactacgttacgttacggacgggttaacgggacctaagggtcgaacgtactaaccgaaacggtacgtggtacggcctagaccttacctagtccttaccgg

SEQ ID NO: 19016 - DNA, 648 bp, Homo sapiens
  misc_feature: GYAE6OF02IUFS3.4.10.A10.1.454.CMB.1.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (367)..(367): a, c, t, g, unknown or other
  misc_feature (367)..(367): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgacatctataggagacagagtcacatcacttcgccggcagtcaggctatttcagttattagctagtatcganaacaaaaacgnggaaacnccctaagtcctacctagatacttagtggtacactactacctacttagacgtaaaggtcgggtaccctagttacgaacggtcaggcggataggtgacttgnggactagttacgttcactctaccgaacctgtacacggtacctacgtacccaacgtacgtacctagtaaacgtttaaccgtttcggaaacctttaacgtttatttaacccgtacggtaacctaaacgtagttaaaccctttaaattaaaccgtttccgaaccgtttccttaaccggtttaccgttaccggggagggtaacggtaaccgtaagggtacgaaggttacctaacgaaaccggtgttacgggacttaccggacgtacctacggtacttcgtttacg

SEQ ID NO: 19017 - DNA, 595 bp, Homo sapiens
  misc_feature: GYAE6OF02H8U79.4.10.A10.1.454.CMB.1.raw
  modified_base (188)..(188): a, c, t, g, unknown or other
  misc_feature (188)..(188): n is a, c, g, or t
  modified_base (229)..(229): a, c, t, g, unknown or other
  misc_feature (229)..(229): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
tcagagcactgtagcacgaccggtgctcgatttagcgtcgatctcgagggggagtcagtcccagtcaggacacagcatggacatgagggtccccgctcagctctgggctcctgctgctctggctcccaggtgccagatgtgccatccgagttgacccagtctccatcctcctgtctgcatctataggnacagatcaccatcacttcgccggctagtcagggctatttcngttattgctggtatcagacaaaacgagggaacnccctaaagctcctagacttactagnggtnactatctacgtttgacgtaaaggtcgggtccaagtntaaggtctaggcgacagtaggctacggtggactaaggtnttacacgtctacgaactatccaagcacgtaccgtaanacgtccgtagaacgttactttcgaacttaaacgtttacttaaacgtggtaaaccaacgttaacggaaactttaataaacgttccgcgttaccttacgtaacggttcgggacggaaggtaccgtaaggttcggaagttaaccacgaaaccggttaactgggtacgtacgtacgaccgtacttacgtcgttccg

SEQ ID NO: 19018 - DNA, 631 bp, Homo sapiens
  misc_feature: GYAE6OF02F467Q.4.10.A10.1.454.CMB.1.raw
  modified_base (273)..(273): a, c, t, g, unknown or other
  misc_feature (273)..(273): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagccttggtatcaagacaaaaaccgagggaaacncccctaagcctcctgatctagtggtgcatcctatttgactaaaggtcggggtacccatcaaggttcagcggcaggtggatcgtaggactagtattcactctcaccatcagcacgcctacacgcctagaagtacttttagaccttaaactttattacgtacgtacaaactagtaactttaagtaaacttaccggtcctaccttaccgtaaccggttttccggggaacggggtaacggggtacccgtaaagggggtcgggtaaacgggtaaccgttaaaccggaaaaccggttaaccggtttacgggttacggggtaccctttacggaaccccgttaacccgtacgttaccgtttaccgg

SEQ ID NO: 19019 - DNA, 550 bp, Homo sapiens
  misc_feature: GYAE6OF02F8Q0G.4.10.A10.1.454.CMB.1.raw
  modified_base (296)..(296): a, c, t, g, unknown or other
  misc_feature (296)..(296): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccgagggaaacgcccctaagctcctgatctatggtncatccactttgactaaaggtcggggtcccagtcaaggttcagcggcaggtggatcgtgggacagtattcactctcaccatcagcacgcctacgacgtcctagaagtatttcgacttaactttattactcgtacaaactagtacttaaataacttacgcgtaccttctacgtttcgggacgggtacgggacgtaagggtggaagactaaccgaaacggtacgttaggtacggctacgaccacctagtccgttacg

SEQ ID NO: 19020 - DNA, 580 bp, Homo sapiens
  misc_feature: GYAE6OF02GKW2X.4.10.A10.1.454.CMB.1.raw
  modified_base (266)..(266): a, c, t, g, unknown or other
  misc_feature (266)..(266): n is a, c, g, or t
  modified_base (422)..(422): a, c, t, g, unknown or other
  misc_feature (422)..(422): n is a, c, g, or t
  modified_base (574)..(574): a, c, t, g, unknown or other
  misc_feature (574)..(574): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctgtaggagacagagtcagcatcacttgccggcaagtcagagcattagctactttttaagtggtatcagcagacacgagggaacncccctaagctcctgatctatgctgcttccgtagtttcgacgaaaggttcggggtaccctagtacgtaaaggttcaggtggactaggtggatcgtagggacagtactttcacttctacacgttgtcagctaggtctaggtactaagtttgaaagttnttttagacttaaacctttacttacgttagtaccaaacgtagttaagttttcaagttaacttcccgttagttacctttccggacgaacgggtaccgtaagggttaccggaaactacgaaaacggtattacgggtacgtctacggactaccgtnttaccg

SEQ ID NO: 19021 - DNA, 579 bp, Homo sapiens
  misc_feature: GYAE6OF02GB4CD.4.10.A10.1.454.CMB.1.raw
  modified_base (300)..(300): a, c, t, g, unknown or other
  misc_feature (300)..(300): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (569)..(569): a, c, t, g, unknown or other
  misc_feature (569)..(569): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttattagccttggtatcaagacaaaaaccgagggaaacgcccctaaagcctcctgatctagtggtncactccactttgactaaaggtcggggtacccatcgtaaggttcacggcggctaggtcggattcgtagggacagtacttcactctacacatcagcacgcctacgcnctagaagttntttagacttaacgtttatacttagtacaacgtagtaactttaaataacttaccgcgtaccttacgtacgtttccgggacggtaacggggtacctaagggtaggaacgtaactaaacgaaacgtaacgtggtaccggtcgtacgacctaaccgtnttaccttacg

SEQ ID NO: 19022 - DNA, 736 bp, Homo sapiens
  misc_feature: GYAE6OF02GTEHG.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgctgggccagtcgagggctattttcagttattagcctggtatcagacaaaacgagggaacaccctaagctacctgactctagtcggtagctactcctacgtttagaacgtaaaggtccgggtacccctaagtaccgtaaacgggttccacgggtaccgggtagtaacggtcgggtaaacgttcgggtacggggtaactaaggttacgttttacccaaccgttccttacccgaaaccctaacttaccgaacggtacctaccggacccgttaaccggacgtacccgttaaggtaaacgtttacgttttacggtaacctttaaacgtttactttacgtacgttaacctaacgtagtttaaacctttaaagttaacgtttaccgtacgtaccctttaccgttaaccgggttttccggggaaccgggtaccgggtaaaccggtaaacgggggttaggaacggttaaacgtaaacccgaaaacggttacgtacgggttacggaccgttacggaccctaacgttacgttacccgg

SEQ ID NO: 19023 - DNA, 694 bp, Homo sapiens
  misc_feature: GYAE6OF02FOT55.4.10.A10.1.454.CMB.1.raw
  modified_base (265)..(265): a, c, t, g, unknown or other
  misc_feature (265)..(265): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcagggctatttcagttattagctggtatcagacaaaacgagggaaacncccctaagcctacctgactcttaagtggtcgactactcccgtacttttagacctaaagggttcggggtaccctagtacgtaaacggtttcgaacggtccgggactagggtggacttcggtagggaactaaggtacttttacgaccttaccttacgaacctactaccgaaggtaccgacggtacccctaacgaacggtcccttaaggaaacgttacgtttttacggaacctttaaacctttaacgtttaacgttcgtaacctaaaacgtaagttaacctttaaaagttaacgtttaaccgacgttacctttaccgtaaccggtttccgggaaccgggtacgggtaaccgaaggggttggaaacgtacgttaaccgaaaacggtacgttacgggtacgacgttaccggaacctaaccgtacgttacgttcg

SEQ ID NO: 19024 - DNA, 572 bp, Homo sapiens
  misc_feature: GYAE6OF02FZA50.4.10.A10.1.454.CMB.1.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
  modified_base (377)..(377): a, c, t, g, unknown or other
  misc_feature (377)..(377): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggccagtcagggcattttcagttattagcctggtatcagacaaaacaggaaacnccctaagctcctgatctatggtgctatcctactttgacgaagttcgggtacccataccgaaggttcagcggacaggtgatcgtaggacagtactttcactctccacatcancacgactacacgacctagaagtattttcgacttaacttacttactgtacaactagtacttaataacttacgacgtcttactacgtttacgggacggtaacgggtaccgtaaggggtacggaaacgtaactaaccgaaaaccggttaacgtgggtacggtacgttaccggaaccctaaccgtacgttccgtttacg

SEQ ID NO: 19025 - DNA, 711 bp, Homo sapiens
  misc_feature: GYAE6OF02HGQ8O.4.10.A10.1.454.CMB.1.raw
  modified_base (279)..(279): a, c, t, g, unknown or other
  misc_feature (279)..(279): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccatccctccctgtctgctatctagtaggagacagagtacaccatcacttcgccggccagtcagggctattttctagttacttagcctggtatcgagaacaaaacgacgggaaacncccctaagcctctgactctagtggtgactactcctacttcgacgtaagggttcggggtaccctacgtacgtaacggttccgaaggccggtacgtaggtacggtactcggtagggtaactaggttactttaccgacttaccgtaccaaccgtacgtaccgacggtaccaccgtaaccctaccgacgtacccgttaaaggtaacgtttacgttttcgtaaaccgtttaaccttttaacgttaaccgttacgtaaccgtaaacgttacgtttaaaccgtttaaagtttaacccgttaacggtacccgttaactttaacccggttacggtttacggggaccgggtaacgggaaccgtaggggtacggaacgtaaccgtaacgaaaccggttacggttaggtaccggacttacggaccgtaaccgtgttcgttaccg

SEQ ID NO: 19026 - DNA, 673 bp, Homo sapiens
  misc_feature: GYAE6OF02G9E9Y.4.10.A10.1.454.CMB.1.raw
  modified_base (279)..(279): a, c, t, g, unknown or other
  misc_feature (279)..(279): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtccaccatcacttcggccgggccagtcgagggctattttcagtttattagccttggtatcagaacaaaaaccgagggaaacncccctaagcctcctagatctagtggtcgctactccctactttggaccgtaaaggtcggggtaccctagtacgtaacggttcaacgggcggtacgtaggtggtacgtcggtaggggaactagtactttaccaccgttacctaccaacccataccgaacgccaacgtaccctacgacggtacctaggtaagttacttttacgaaccttaaaccgtttatttaacgtacgttaaccaacgttacgttaacttttaaacgtaaacgttaccgtccgttaccttaccgttaccggtttacggggacggtaacgggtaccggtaagggtacggaacgtacgttaaaccgaaacggttacgttggtacggtccgtacggaccctaaccgtacttcgttccg

SEQ ID NO: 19027 - DNA, 573 bp, Homo sapiens
  misc_feature: GYAE6OF02FV2DH.4.10.A10.1.454.CMB.1.raw
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (457)..(457): a, c, t, g, unknown or other
  misc_feature (457)..(457): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggcattttcagttattagcctggtatcagacaaaaaccgagggaaacncccctaagcctcctgatctatggtgcatcccatttgctaaaggtcggggtacccagtaccgaaggttcaggtccggntaggtggactcggtggggaacaggtactttcactccgtaccacctatccgagcctacgacccttaacgacgtccctagaacgttattttcgacttaaactttattaacgtntaccaactatacttaataacttacgctacttactacgtttcgggaggtacggacgtaagggtggaacgtataaccgaaacgtacgtggttcgcgttagacctacctagtccttacg

SEQ ID NO: 19028 - DNA, 861 bp, Homo sapiens
  misc_feature: GYAE6OF02H5G8H.4.10.A10.1.454.CMB.1.raw
  modified_base (120)..(120): a, c, t, g, unknown or other
  misc_feature (120)..(120): n is a, c, g, or t
tcagagcactgtagcacgaccggtgctcgatttagcgtcgatctcagggggagtcagtcccagtcaggacacagcatggacatgagggtccccgctcagctcctggggctcctgctgctntggctcccaggtgccagatgtgccatccagttgacccagtctccatcctccctgtctgcatctaataggagacagagtcaccatcacttcggccgggccagtcgagggtctatttttcagtttatttacgccgttggtatcaagaccaaaaacgacgggaaacgtacccctaagtcctccctagacttacgtagtggtacgtacacgtttaccctaacgttttacgaccgtaaaagggttccgggggtaccctaacgttaccgtaaacgggtttccaaacgggtccgggtaccgtaacgggttaggtaacgttaccggttacggggtaacgttaacgttaacctttttaccgaccgttttaccctaaccctaaccgtaaccttaccgaaccggcccgtaaacgggtccccttaaaccggtacggacccgtttaagggtaaacgttttaacgtttttaccggtaaccttaaaccgtttttaaactttaccggttacgttaaacccgtaaacgtttaaacggttaaaacctttttaaacgttaaaaccggttttacgtaaccgttaccctttaacccgttaaccgggtttttacccggggaacccgggggaaacgggttaacccggtaaagggggttacgggtaaacggttaaacccgttaaccggtaaaacccggtaaacggttccgggttagggtaacccttaccgggtaaccctaacccgttacgttaccggttttaacg

SEQ ID NO: 19029 - DNA, 713 bp, Homo sapiens
  misc_feature: GYAE6OF02FKRGB.4.10.A10.1.454.CMB.1.raw
  modified_base (270)..(270): a, c, t, g, unknown or other
  misc_feature (270)..(270): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccgagggaaacncccctaagcctcctgactctatggtgctatccactttgactaaaggtcggggtacccagtcgaaggttcaggcggacaggtggatcgtaggggactagtactttacgactcctacaaccctataccgacggccaacggtaccctaacgacggtaccctaggaacgttattttacggaccttaaactttacttaaccgttcgttaaccgaaacgttaacggttaaccttttaaaagttaaaaccgtttaccgggaccgttaccgttaccgttaacccggttttaccgggggaacccggggtaaccgggggtaacccgtaaagggggttacggggtaaacggtaaccgttaaacccggtaaaaacccgggttaacccggtttagggtacccggggttaccgtaccgggtaaccctaaccccggttaacgttcccggtttaaccgg

SEQ ID NO: 19030 - DNA, 706 bp, Homo sapiens
  misc_feature: GYAE6OF02H5IQ2.4.10.A10.1.454.CMB.1.raw
  modified_base (263)..(263): a, c, t, g, unknown or other
  misc_feature (263)..(263): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggcagtcaggctattttcagttatttagcctgtatcagacaaaacaggaacnccctaagctcctagatctatggtcgactactcctactttagacgtaaaggtcgggtaccagtacgtaaggttccaggcgagtagtaggtatcgtgggaacagtactttcgtaacttccgtacaaccatcgaacgactaacggtaccctagacgtacctaggtaaacgttacgttttacggaacctttaaacgtttaacgtttaacccgttaggtaaacccctaaacgttaaccgttaaacttttaaaaccgttaaacctttaccgggtacccgttaccgtttaacccgttaacggtttccggggaaccggggtaaaccggggtacccggtaaggggtttaacgggaaccggtaaaccttaaacgggaaaaacccgggttaacgttaccggggttacggtaccgtaccggtaacccgtacccgtttacgttacggtttaccccg

SEQ ID NO: 19031 - DNA, 633 bp, Homo sapiens
  misc_feature: GYAE6OF02GHLVJ.4.10.A10.1.454.CMB.1.raw
  modified_base (276)..(276): a, c, t, g, unknown or other
  misc_feature (276)..(276): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttcggccgggccaggtcagggctattttcagttatttagtcctggtatcagacaaaaaccgagggaaacncccctaagcctccgtagacttctagtggtcgctaactcctatttcgacgtaaaggtcggggtacccagtacgtaaggttcacggtcggtacgagggtaggacttcggtaggggactaggttactttccacttctaccaccatcacgcaacgcctactagtactagacttagtttacgactttaacttacttacgtagtaaccaacgtagttaacttaaattaacgttaccgtcctaccttcgtaaccgtttccggggaacgggtaacgggtaccgtaaggggtaggaacgttaacgtaacgtaaacggtaacgttgggtaccgtcgtaccggtacctaaccggtacttcgttaccgg

SEQ ID NO: 19032 - DNA, 658 bp, Homo sapiens
  misc_feature: GYAE6OF02H10DR.4.10.A10.1.454.CMB.1.raw
  modified_base (275)..(275): a, c, t, g, unknown or other
  misc_feature (275)..(275): n is a, c, g, or t
  modified_base (364)..(364): a, c, t, g, unknown or other
  misc_feature (364)..(364): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatccctccctgtctagcatctaataggagacagatcaccatcacttggccgggccagtccgagggctattttcagttattagcctggtatcagacaaaaacagggaaacnccctaagctcctagatcgtaagtggtacgcactacctactttggactaaagggtcgggttacccagttaccgaaagttcgagccggganaggttacggatcgtggggaactagtaactttcgacttctacgactatacgagcagtaccttacgacgtccgtaagtaagttacttttacggaacttaactttattaaccgtaggtaacctaaagtaacggttaacgtttaacccgaaccgtttaccccgtaccgttacttaccgttacggttttacgggaccgggtaacgggacccgtaaagggttcggaactaacgttaaccggaaaacgttaacgtttgggacggttactaccggaaccctaacgtacgttcccgttaacgg

SEQ ID NO: 19033 - DNA, 625 bp, Homo sapiens
  misc_feature: GYAE6OF02GBIRV.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctatttcagttatttacgccttggtatcagaccaaaaaccgagggaaacgcccctaagcctacctgatctagtggtgctatcctacttgacgtaaaggtcggggtaccagtcgtaaggttcgaggcggacgtaggtggactcgtagggacagtactttaccacttctaccaacctactcacgaccacgtaccctacgacgtacctaggaaacgttattttacgaccttaaactttacgttactcgtaacctaactaagttactttaaagtaacgttaccgacgttccttaccgttacggtttaccgggacggggtaacgggtacgaaggggtaggaacggtaacctaacggtaaaccgtaacgtggttacggtccgtacgaccaaccgttagtccgttacg

SEQ ID NO: 19034 - DNA, 565 bp, Homo sapiens
  misc_feature: GYAE6OF02GXA2T.4.10.A10.1.454.CMB.1.raw
  modified_base (191)..(191): a, c, t, g, unknown or other
  misc_feature (191)..(191): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (510)..(510): a, c, t, g, unknown or other
  misc_feature (510)..(510): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttgccgggcagtcagggctatttcagttattagcctggtatcagacaaaaaccgngggaaancccctaaagcctccgtgatcctagtggtncatccatttgacaaaggtcggggtacccagtccgaaaggttcaaggtcggactaggtcggatcgtagggacaggtactttcacttcacacgtatcaagcacggaccctagacgtcctagaagtattttcgacttaactttatactagtacaacgtatactttaataacttacgctactactacgttcggacggagggtacctagggtagganaacgtaccgaaaacgtacgttggtacggtaccttagaccgtacctagtccttacg

SEQ ID NO: 19035 - DNA, 786 bp, Homo sapiens
  misc_feature: GYAE6OF02F8B7B.4.10.A10.1.454.CMB.1.raw
  modified_base (192)..(192): a, c, t, g, unknown or other
  misc_feature (192)..(192): n is a, c, g, or t
  modified_base (310)..(310): a, c, t, g, unknown or other
  misc_feature (310)..(310): n is a, c, g, or t
tcagagcactgtagcacgaccggtgctcgatttagcgtcgatctcgagggggagtcagtcccagtcaggacacagcatggacatgagggtccccgctcagctcctgggctcctgctgctctggctcccaggtgccagatgtgccatccagttcgacccagtctccatcctccctgtctgctatctatagganacagagtaccacatcacgttcggccggcagtcgagggtctagttttcagtttattacgctggtactacaacgacaaaaccgaggaaacgccctaagcctctgtactcgtagtcggtanctactacctacgtttcgacgtaaacgggtcgggtaccacgttaccgtaacggttccgaacgggtccggtaccgtagggtacggtacgttcggtacggggtaactacgttacgtttaccgtaccgttcccgtacctaaccgtaactaccgaacgtacccgtaaacggtacccttaaacgggtaccgttaccgtaagggttaaacgtttacgttttaacggaccttttaaacgtttacgttaaccgtacgttaaccgtaaacgttacgttaaaccttttaaacgttaaaccgtttcccggtaaccgttacccgtttaaccgttaaccggtttaccccgggggaacgggttaaacccggggtaccggttaaacggggtacgggtaaaccggtaaccgttaaaaccggaaaaccggttacgggttacgggttaccggtaccgtaaccggtaaccctaccgtttaaccgttcccgttaccg

SEQ ID NO: 19036 - DNA, 549 bp, Homo sapiens
  misc_feature: GYAE6OF02HLXZA.4.10.A10.1.454.CMB.1.raw
  modified_base (191)..(191): a, c, t, g, unknown or other
  misc_feature (191)..(191): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcacttcgccgggcagtcagggctattttcagttatttgcctgtatcagacaaaacgagggaacncccctaagctcctgactctagtggtnacatcctatttgactaaaggtcgggtaccagtcgaaggttcagcgganaggtgactcgtaggacagtatttcactctacactatcagcacgactacacgcctagtaagttatttacgacttaaactttnttactgtaaccaactagtactttaaatacgttaccgcttactacgtacgttcgggacgggtaggacctaagggtcgaacgactaacgaaacgtacgtggtcggactacgacctactagttcgtacg

SEQ ID NO: 19037 - DNA, 664 bp, Homo sapiens
  misc_feature: GYAE6OF02FYWWK.4.10.A10.1.454.CMB.1.raw
  modified_base (273)..(273): a, c, t, g, unknown or other
  misc_feature (273)..(273): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatcctccctgtctgcatctataggagacagagtcaccatcacttgccggcagtcagggctattttcagttatttagccttggtatcgaagaccaaaaaccgagggaaacncccctaagcctactgactctagtggtgctactcctactttgactaaaggtcggggtacccagtaccgtaaggttcgaggtccgggctaaggttcggaacgttcgtaggggaacctaggttaactttccgacttcgtaccaacctactccaacgacctacgaccctaacgacgtaccttaacggtaacgttaacttttcgaaccttaaactttacgttaactacgtaactaaactacggttaactttaaacgttaaacgttaccgtacgttaccttacgttaaccggtttcgggaccgggtacggtacccgaaggggttacggaacgtaacgtaacccgtaaacggtaacgttacgggtacgacgtcggaaccctacctagttccgttaccg

SEQ ID NO: 19038 - DNA, 859 bp, Homo sapiens
  misc_feature: GYAE6OF02JFB26.4.10.A10.1.454.CMB.1.raw
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttcgaccctagtcctccatcctccctgtctgcatctataggagacagacgtcaccatcacttcggccggccagtcgagggtcctagttttcgtaagtttagtttacgtccgttaggttactacgaacgaaccgaaaaaaccggacggggtaaaaaccgtcccccgttaaaaggtcccttaccgttacggtaacttaccgttaaggttcgggttacgtaccctaacgtttccccttaaacgtttttacgggaaaccgttaaaacggggttcccgggggttaacccctaaggtttaaccggtaaacggtttaccggaacgggtccgggtacgtacgggtacggtacgttacgggtacgggtaacgtacgttacgtttacccgaaccgtttacctaccgtaaccgtaacttaccgaaccggtccgtaaccggtacccttaacgtaccggttaccggttaaggtaaacgttttacgtttacggaaccctttaaacgttccgtttaacgttaccggtaaacttaaccgtaaacgttaacctttaaacggttaaaccgttaaccggtccttaaccgttaccgtttaaacccggttaccggggtaacggggtaacccgggtaacgtaaacggggtttacggaaaccggttaaattaaccggtaaaccgtaaggttcgggtacgtaccgtaccgaccgttaacctgttacccgttacg

SEQ ID NO: 19039 - DNA, 668 bp, Homo sapiens
  misc_feature: GYAE6OF02JOYMG.4.10.A10.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (506)..(506): a, c, t, g, unknown or other
  misc_feature (506)..(506): n is a, c, g, or t
tcagagcactgtagcacgaccggtgctcgatttagcgtcgatctcgaggggagtcagtcccagtcaggacacagcatggacatgaggtcccgctcagctcctgggctcctgctgctctggctcccaggtcgccagatgtgccatcccagttgacccagtcctccactcccgtccctgtctgccatcctagtagganacacgagtccactatcacttcggccggccaagtcgaggtctattttccagttatttanccgttggtatacagaaccaaaaccgagggaacncccctaagccttaccgtgactctagtggtcgctactcctacgtttacgacgtaaacggttcgggtacctacgttaccgtaacggttcgaacggccggtaccgaggtttacggacgttacggttacggggaaccttaggtaaccttttactaccgttacttacccgaacgtcgtacgacggtaaccgtcgtacccgtagacgtaccgtagtaaacgtttntttacgacttaacgtttataccgtgtacctaacgtcgtaactttaagttacgttacgtcgtactaccggtaacgtttcgggaccgtacggtaacgtacggtaggtaacaattaaccggaactacgttcggcgacggttccaacggtaccttcaccggtttac

SEQ ID NO: 19040 - DNA, 739 bp, Homo sapiens
  misc_feature: GYAE6OF02IWZM9.4.10.A10.1.454.CMB.1.raw
tcagagcactgtagcacgaccggtgctcgatttagcgtcgatctcagggggagtcagtcccagtcaggacacagcatggacatgagggtccccgctcagctcctgggctcctgctgctctggctcccaggtcgccagatgtgccatccagttgacccagtctccatcctcctgtctgcatctataggagacagagtcaccatcactcgccggcagtcaaggctactttctagttatttacgcctggtatacgagacctaaaaacgagggaaacacccctaagtctccgtagatcttagtggtcgactactcccagtttacgaacgtaaacggtcggggtacccaagttacgtaaacggttcgaacgggtccggtacgaaggttacgggtaattccggttacgggggaactaacgggttaacttttccgtaacctccgttacccgaaacctacgttacctaaacgggccctaaacccggtccccgttaagaaaccggtcccgttaaggtaaacgtttaacgttttacgtacccgttaaaacgttttaccgttaaccgtttacggtacctaaaaccttaagttaaccgttttaaactaaccgttttaaccggccgtttaactaccgggtttaaccgttacggggacgggttaaaccggggaccttaagggtacggaacgttaaccttaacggaaacgtaaccgttggtaccgtcgtacgacctaaccgtagttccttacgg

SEQ ID NO: 19041 - DNA, 707 bp, Homo sapiens
  misc_feature: GYAE6OF02JB18O.4.10.A10.1.454.CMB.1.raw
  modified_base (280)..(280): a, c, t, g, unknown or other
  misc_feature (280)..(280): n is a, c, g, or t
tcagagcactgtagcacgaccggtgctcgatttagcgtcgatctcagggggagtcagtcccagtcaggacacagcatggacatgagggtccccgctcagctccgtggggctcctgctgctctggctcccaggtgcagatgtgccatccagttcgacccagtcctccatccctccctgtctgcatctataggagacagatcaccatcacttcggcccgggccaggtcgagggctattttcagtttatttagctggtatcagaacgaaaaccgaggaaaccncccctaagtcctcgtagattactagtggtcgctactcctacgtttacgaacgtaagggttccgggtacctacgtacgtaaggtaccgacggcggacgtacggtagtacgtcggtagggtaacgtacgttactttccaccgtttactacccaccgtaactccgagtcccgtaaccgaccgtaaccgaccggttaccgtaagttaaccgtttatttacgaaccctttaaacttacctttacgtaccgttaactaaacgtacgtttaaacctttaaaagttaaccgtttccgaccgttaccgttaccgttacggggtttacccgggacgggggtaaccgggaaccgtacgggtaaggtaacccgttaaggtaaaccgtaaccgtaacggtcggtaccgtacgttacccgactacccgttagtcctttacg

SEQ ID NO: 19042 - DNA, 603 bp, Homo sapiens
  misc_feature: GYAE6OF02GVK1Q.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttattagcctggtatcagacaaaaaccagggaaacgcccctaagctcctgatctatggtgcatccactttgcaaagtcggggtcccatcaaggttcagcggcagtggatcgtgggacagtatttcactctcaccatcagcagccctaacacgccctagaacgtatttttacgacttaaactttaattacttagtaccaaacgtagtacctttaaataacgttaaccgccgtacttaccgtaccgttttccgggaccgggtaacggggtacccgtaaggggtcgggtaacggtaacgttaacccgaaaaccggtaaccttacggggttacggtccgttacgggaccctaacccgtaacgttccgttaccgg

SEQ ID NO: 19043 - DNA, 612 bp, Homo sapiens
  misc_feature: GYAE6OF02ISAI5.4.10.A10.1.454.CMB.1.raw
  modified_base (299)..(299): a, c, t, g, unknown or other
  misc_feature (299)..(299): n is a, c, g, or t
  modified_base (385)..(385): a, c, t, g, unknown or other
  misc_feature (385)..(385): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatggtgccgatccgagttgacccagtctccatcctcctgtctgcatctataggagacagagtcaccatcacttcgccgggccaggtcagggctattttcagtttattagcctggtatcgagacaaaaccgagggaacacccctaagcctcgtgatctagtggnctactccgtatttcgacaaaggtcgggtaccatcaaggttcacggcgcgtagtcggtatcggtagggacaggtactttcacgttcnccgtactactcgagccacgtacctacgacgcctagtaagttcttttacgacttaactttaacttcgtacgtacaactagttaaccgttaaattaacttacgtcgtacctttactaccggttacgggacgggtaccgggaaccgtaagggtacgggtaaggtaaacttaacggaaaccggtaacgttacgggacggttaccgtacggacctaccggtattcgttaccg

SEQ ID NO: 19044 - DNA, 541 bp, Homo sapiens
  misc_feature: GYAE6OF02IS77F.4.10.A10.1.454.CMB.1.raw
  modified_base (270)..(270): a, c, t, g, unknown or other
  misc_feature (270)..(270): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagacaaaaaccagggaaacncccctaaagctcctgatctatggtgcatccactttgacaaagtggggtcccatcaaggttcagcggcagtggatcgtagggacagatttcactctacaccatcagcagcctaacagcctagaaagtnttttgactaaactttattactntacaatagtactttaaataacttacgcgtctactacgtttcgggacggaagggaccaagggttcggaaggtactaacgaaaacgaacgttggtacggtctacggaccaaccgtattcgtacg

SEQ ID NO: 19045 - DNA, 522 bp, Homo sapiens
  misc_feature: GYAE6OF02F9OS2.4.10.A10.1.454.CMB.1.raw
  modified_base (268)..(268): a, c, t, g, unknown or other
  misc_feature (268)..(268): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaancccctaagctcctgatctatggtgcatccatttgacaaaggtggggtacccatcaaggttcagcggcagtgatcgtgggacagtatttcactctcaccatcagcagcctacagcctagaagtntttgctaaattnttactgtaccaactgtacttaataattcgctctactacgtttccggacggacgggacctaaggggtgaacgaacttacgaaaacgtacgttggtacggcttagaccgtaccattctacg

SEQ ID NO: 19046 - DNA, 591 bp, Homo sapiens
  misc_feature: GYAE6OF02HIUFW.4.10.A10.1.454.CMB.1.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcgagggcattttcagtttatttagcctggtatcagacaaaaccgaggaaacncccctaagctcctgtatctagtggtncactcctactttgacaaaggtcggggtaccctagtaccaaggttcgagtcgggcgaaggttggaagtcgtagggtacaagtactttccactcctacaccctatccgagcgactacctacagtccctagaacgttagttttacgacctaaacttattactgtacaactagttaccttaaatacttaccgcgtaccttacgtaccgtttacgggacggtacgggtaccaaggggttcgaaggttacgtaactaaacggtacgtggtacggtctacggacctacccgtatcgttcgg

SEQ ID NO: 19047 - DNA, 708 bp, Homo sapiens
  misc_feature: GYAE6OF02HA1ZL.4.10.A10.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (319)..(319): a, c, t, g, unknown or other
  misc_feature (319)..(319): n is a, c, g, or t
  modified_base (678)..(678): a, c, t, g, unknown or other
  misc_feature (678)..(678): n is a, c, g, or t
tcagagcactgtagcacgaccggtgctcgatttagcgtcgatctcgagggggagtcagtcccagtcaggacacagcatggacatgagggtccccgctcagctccgtgggctcctgctgctctggctcccaggtgccagatgtcgccatcctagttcgaccctagtccctccactccctccctgtctgctatctagtagganacgagtacgtccacctatctacgttcggcccggccagtcgaggtctactttntagtttattacgccgttaggtatacgaagaaccgaaaaccgaggaaacgtacccctaagcctaccngtactcgtagtgtctctacttccgtacttacgacgtaacgggtcggtaccctaagtacgtaacggttcgacgcggtactacggtaggtacgtcgtacggactagttacctaccgtacttaccgtacaacctactaccgacgtacctaaccgtccgtaaccgtacggtacgttaacgtaacgttttagttaaccgttaacctttaaccgtttaacttacgttacgttaactaaaccgttatttaaaccgtttaaactttaaccggtacctaccgtttccgttacccggttaacggtttcccgggggaaccgtaacggggtaccgtaagggtacggtaacaccgttaacgaacggttacgnggttacgcgtacgactaccctgtcgttacg

SEQ ID NO: 19048 - DNA, 630 bp, Homo sapiens
  misc_feature: GYAE6OF02HKRKM.4.10.A10.1.454.CMB.1.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (346)..(346): a, c, t, g, unknown or other
  misc_feature (346)..(346): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctatttcagttattagcctggtatcagacaaaacgaggaaacnccctaagctactgatctanggtncatcctattgacaaggtcgggtccagtcgaaggtcagcgctagtgatcgtaggganacggttattaccacttccaccacctatccgagaccacgtacctacgacgtaccttaggaaacgttatttacggaccttaacgttttacttacgttacgtaacctaaacgtacgttaactttaaattaacgttaccggtactaccgttaacttacccggtttacgggaccgggtaaggggtaccgtaaacggggttacgggaacgtaacgttaacccggtaaaaacgttccggtacggttaccgggaccttaggaaccccgtacccgtaacgttccctttaccgg

SEQ ID NO: 19049 - DNA, 698 bp, Homo sapiens
  misc_feature: GYAE6OF02GGL8J.4.10.A10.1.454.CMB.1.raw
  modified_base (188)..(188): a, c, t, g, unknown or other
  misc_feature (188)..(188): n is a, c, g, or t
  modified_base (261)..(261): a, c, t, g, unknown or other
  misc_feature (261)..(261): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatcctcctgtctgcatctatagganacagagtcacatcacttgccggcagtcaggctatttcgagttattacgctggtatcagacaaaacgaggaacnccctaagctacctgactcgtagtggtcgactacgtcctagtttacgacgtaaacggtcggggtacccagttacgtaacggttcgaacggtcggactaggtacggtaataccggtaggggtaactaggttactttccacttcctaccaacccgtattaccgaacgtaccgaacgtaccccttaacgaaccggttacccgttaaggtaaacgttagtttttaccgaaacccgtttaaacttttaacgtttaccgttaacggttaaaccctaaacgttaaccgttaacgttttaaaacttaaccgtttaaccgaccgtttacctttacgttaccggtttaccgggacgggttaacgggtacctaggggtacgaacgtaacgttaaccgaaacgtacggttggacggttacgtaccgtactaccgtagttccgttaaccgg

SEQ ID NO: 19050 - DNA, 573 bp, Homo sapiens
  misc_feature: GYAE6OF02HIXQ2.4.10.A10.1.454.CMB.1.raw
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagtttatttagcctggtatcaagacaaaaaccagggaaacgcccctaagcctacctgactctagtggtgcatccactttagctaaaggtcggggtacccatcgtaaggttcagcggcagtggatcgtagggacngtatttcactcncaccatcagcagcctacgacgcctaggaagttattttcgacttaactttattactcgtaccaactacgtactttaaagtaactttaccgcgtacttacgttacgtttccgggacgggtaacgggtaccgtaagggtggaacggtaactacggaaacctaacggttggtcggactccgactaccgtattcgttacg

SEQ ID NO: 19051 - DNA, 734 bp, Homo sapiens
  misc_feature: GYAE6OF02FIN9F.4.10.A10.1.454.CMB.1.raw
  modified_base (95)..(95): a, c, t, g, unknown or other
  misc_feature (95)..(95): n is a, c, g, or t
  modified_base (201)..(201): a, c, t, g, unknown or other
  misc_feature (201)..(201): n is a, c, g, or t
tcagagcactgtagcacgaccggtgctcgatttagcgtcgatctcagggggagtcagtcccagtcaggacacagcatggacatgagggtccccgntcagctcctgggctcctgctgctctggctcccaggtgccagatgtgccattccagttcgaacccctgtcctccactccctccctgtcctgtacatctagtacgganaccagacgtccaccatcccgtacgtcgcccgggaccaggttccgacggggtccttacgttttcgtaagtttacgttaacgcccgttagggtactccgaacgaacccctaaaaacccggacggggaaaacctccccccgtaatccgtaccctacgtactacttagtggtcactacgttcccgtattacggaccgtaacggtccgggtacccagcgttacggtacaggccgagtaggacgtacgtctaggacctagttacttaccgcctctacccactctccgaacgactaccgtcctaacgcgttacccgagtaacgtttcttaaccacctttaaacgttactaccggttctaaccctaaacgtattaaccctaaatttaccgttaacccgtccgttaccgttaacccgtcgggtttaaacccgggcggggtaaaccggtaccggtaacgggtcccggtaaacggtaccgtaaacccgaaacgttccggtacggttacgccgttaccgaccgtaccttacttcccgtttacccg

SEQ ID NO: 19052 - DNA, 606 bp, Homo sapiens
  misc_feature: GYAE6OF02F1HDG.4.10.A10.1.454.CMB.1.raw
  modified_base (276)..(276): a, c, t, g, unknown or other
  misc_feature (276)..(276): n is a, c, g, or t
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtgccatccagttgacccagtctccatccctccctgtctgcatctataggagacagagtcaccatcacttgccgggccagtcagggctattttcagttattagccttggtatcaagaccaaaaaccgagggaaacncccctaagcctacctgatctagtggtcgctactcctactttgacgtaaggtcggggtacccagtacgaaggttcaggtcggacaggtggtagtcgtaggggactagttactttacgactactacaccatccagtcacgtccctaacgacgtcctaggtaacgttattttacgaccttaaactttacttactacgtaacaaactagtaactttaaataacgttccgcgtacttccgtacgttccgggacgggtacggtaccgtaagggtacggtaagtaactaaccgaaacgtacgtggtacgggtactacggacctaccgtatcgttacg

SEQ ID NO: 19053 - DNA, 715 bp, Homo sapiens
  misc_feature: GYAE6OF02GER2Z.4.10.A10.1.454.CMB.1.raw
  modified_base (272)..(272): a, c, t, g, unknown or other
  misc_feature (272)..(272): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacgttcgccgggcagtcgagggctattttcagtttattagcctggtatcaagacaaaaacgaggaacncccctaagcctacgtagatcgtagtggtacgacactcctactttagacgtaaagggtccggggtaccaagtacgtaaacggttacagggtccggacgtagggtaggacgttacgtaggggtaaacctaaggttactttacccgacctttacctaccaaccctactaccgacggtaccaaccggtaccctaacgaccggtacccgttaaggtaaacggtttacttttacggaacctttaaacgtttaacgtttaaccgtacgttaaccaaacgttacgttaaactttaaacttaacgttaccggccttaccttacgttaaccggtttaccgggacggggttaacgggaccgtaaggggtacggtaaacggtaacttaaacccggaaaacggaacgttttacgggacggtacgtaacggtacccaacgttaacgttcgtttaacg

SEQ ID NO: 19054 - DNA, 668 bp, Homo sapiens
  misc_feature: GYAE6OF02H1RXB.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccatccctccctgtctgcatctagtaggagacagagtcaaccatcacgttcgccgggccagtcgaggctattttcgtagtttatttagccttaggtactacagaacaaaaaaccgaacgggtaaaacgtacccctaaagtcctaccgtagtactacttaagtcggtacgacctaacttccctaacttttacggacgtaaacgggtcggggtaccctatacgtaaacggttcaacggcggacgtaggttacggtacgtcgtagggactagtactttaccaccttacctacaaccatacacgcctaacgccctaacgacgtcgtaagtaagttattttacgacttaaactttacttacgtataaccaataacgtaacttaaataacgtttacgacttctacgtacgttacggacgggtaaccggtacgaacgggtacggaacgtaacgtaaccgaaacgttacgttacggtacggtacgtaccgaccgtaacctacgttcgttaacg

SEQ ID NO: 19055 - DNA, 890 bp, Homo sapiens
  misc_feature: GYAE6OF02HRGNZ.4.10.A10.1.454.CMB.1.raw
  modified_base (130)..(130): a, c, t, g, unknown or other
  misc_feature (130)..(130): n is a, c, g, or t
  modified_base (183)..(183): a, c, t, g, unknown or other
  misc_feature (183)..(183): n is a, c, g, or t
  modified_base (213)..(213): a, c, t, g, unknown or other
  misc_feature (213)..(213): n is a, c, g, or t
tcagagcactgtagcacgaccggtgctcgatttagcgtcgatctcagggggagtcagtcccagtcaggacacagcatggacatgacgggtccccgctcagctcctggggctcctgctgcctcgtcgtccncgtgccgacgatgtgccactctacgtgtccacgtcgtcctactcctcctcgtntacgcactctataggaagagacgtacgtanaccacgtactccgtacgtccgggacccgacgtacgtacggtacgtacttttacttacgttatttaacggtcctcgttacggttacaacgaaaccgaaaaaccgaaaacggggtaaccggtaaccctaaaccgggtccttacccgttggtataaccgttgttacgcggtaccgtaactcgttaacccgtttgtaaacggtaaacgggtccgggttaccggttaaccaacgttaacggggtaaccgttcgggaaacttcccgggggtaattacgggggaattacggtaccgggggtttaacgaaaagtttttccgttacggtttaaccccctcgtttaaacccacccgtaaacgtaccgaacgtaaaccggtaccgtaaccgtaccgtaaccggttaaccgtaacggttaaaggttttaaccttacggtttaaaccgttaacctttaaacgtttaccgttaaccgttaataaacccgttaacgtttaaactttaaaccgtttaacgtacccgttaaacggtccgttaaccggttaccggttaaccgggttaaccgggggaaccgggttaagtaaccggggttaaggtaaccggtaactaaacccggtaaaccgtaaccggttacgggtaccgtaccggtaacgttaccggtaccctttacgttcccgttaccggttacc

SEQ ID NO: 19056 - DNA, 697 bp, Homo sapiens
  misc_feature: GYAE6OF02GZFZB.4.10.A10.1.454.CMB.1.raw
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatccctccctgtctgcatctatagggagacagagtcaccgatcacttcggccggccagtcgagggtctagttttcgagtttattacggccttggtactacgacgtaaccgaaaaacccgagggtaaaccgccccctaaaggtccctaccgtacggtacttctacgtggtacgcgtactcctacgttagacgtaaggtcggtacccagtacgtaggttcgaggtcgcgtagtgagtcgtaggaacgagtacttcgacctcgtacctacgacctcgtacgcctaaccggtaccctacgaccgtaccgtaagtaacggtttactttacgtaaccctttaaacgtttaccgttttaacgtacttaacccgaaaccgtttaacggttaccttttaaaagttaaccctttaccggtccgttaaccttccggtttaccggtttaccgggacgggttaacggacggtaagggtacggaagtaacgttaaccggaaacgttacgtacggtcgtaccgtcggacctacgtaccgtcgtttaccg

SEQ ID NO: 19057 - DNA, 744 bp, Homo sapiens
  misc_feature: GYAE6OF02H3LJS.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctcctgtctgcatctatggagacagagtcaccatcacttgccgggcagtcgaggcttatttcagtttattacgccttaggtactcagaaccaaaacgagggaacgccctaagctccgtagacttacgtagtggtcactactccttagtttagaacgtaaagggttccggggtaccctaagttaccgtaaaggtttccgaaggcggacgtagggtaggaacttcggtaggggactaaggttactttacactttcctacgaacctatcgacgacacgtaccctaagacgtcctaagtaacgtttacttttacgaaccttaaacgttttaacttaacgttcgtaaaccctaaacggtactttaaaccgttttaaaaagttaaccgtttaaccggaccccgtttaaccgtttcccgttaaacgggtttttccccggggggaacggggtaaacccggggaacccggtttaaacgggggttacggtaaacggtaaccctttaaaccggtaaaaaccggttaacggtttcgggtaacgggtccgtttaaccggaccctaaacggttcgttacccgttttaacgg

SEQ ID NO: 19058 - DNA, 634 bp, Homo sapiens
  misc_feature: GYAE6OF02JAY0Z.4.10.A10.1.454.CMB.1.raw
  modified_base (191)..(191): a, c, t, g, unknown or other
  misc_feature (191)..(191): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgctatctatagganacgagagtcacatcacttcgccggccagtcagggctattttcgagttattagcctgtatcaagacaaaacgaggaaacgccctaagtctactgatcgtatggtgacattcctacgttagacgtaaaggtcgggtacccataccgaaggttcacggcgacaggtgagtcgaggatagtactttcacctcgtaccaacgtactactacgacgacgtacctagaccgttaccgtaggtaaagtttccgtttaacaaccttaagttaacttaccgtacggtaacctaaacgtaacgttaacctttaaaacgttaacgttaccggtacccgttaacttacccggttaaacgtttccggggaaccggtaacgggaccggtaaggtaggaaactaaccggttaaacgaaacgttaacgtggtacgtactccggaactcgtaacttgtacg

SEQ ID NO: 19059 - DNA, 655 bp, Homo sapiens
  misc_feature: GYAE6OF02HQYTV.4.10.A10.1.454.CMB.1.raw
  modified_base (207)..(207): a, c, t, g, unknown or other
  misc_feature (207)..(207): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggactcccaggtgccagatgtgccatccagttcgaccctagtctccactccctccctgtctgcatctataggagacagagtccacntcacttgcccggcagtcgaggctagttttacagttattggccttggtactacgacgaaaccaaaaaccgaggggtaaaaccgtcccctaaacggccttacccgtaggtacttacgtaggtcggtcgacctacgtccctacgtttacgacgtaagggttccgggacctagtacgtaaggttcgagcggacgtaggtggtacgtcgtacgggactagtactttccacttctccgaacctagtacgtacggctaaccgcctaacgtacgccgttaaggtagttactttacgacttaaccgttttattccgtacgtactaaacgtacttaactttaaacttacgttaaccgcgttaccttacgtgttaccggggaggtacgggacctaagggtcggaactacgtaactaaacggcgttagggcgtacgtcaacccgtacttagtcgttaacg

SEQ ID NO: 19060 - DNA, 816 bp, Homo sapiens
  misc_feature: GYAE6OF02IW7IN.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtcctccactccctccctgtctgcatctagtaggagacagacgtcaccatcctacgttcggcccgggaccacggtcgacgggtctattttctaagttttatttacggtccttggttaactacgaacgaaacccgtaaaaaaccggaacggggaaaaccgtaccccctaaacgtcccttacccgttacggtaactttacgttaggttacggggttcgaccttacttacccgttaacgtttacggaaccggtaaacgggttccggggtaccctaagtaccgtaacggttcgacggtccggcgtaggtaggtacgttcggtacgggactaggttactttacctaccgtttcctacctaaccctattacccgaacgaccgtaaccgtacccctaacgaccgtaccgtaaggttaaacgtttacgtttactaaccgtttaaactttacgttaaccgtactaaaccgtaaacgttaacgtttaactttaaacgttaaccgttaccggtacgttcctttaacccggtaaccggttttcggggaaccgggtaacgggtaccggtaagggttacggtaaacgtaaaccggtaaaccggtaaacggttaccggttaggtaccggtaccgttaccggtaaccctaaccgttacgttacccgtttacgg

SEQ ID NO: 19061 - DNA, 621 bp, Homo sapiens
  misc_feature: GYAE6OF02JBJ05.4.10.A10.1.454.CMB.1.raw
  modified_base (140)..(140): a, c, t, g, unknown or other
  misc_feature (140)..(140): n is a, c, g, or t
  modified_base (161)..(161): a, c, t, g, unknown or other
  misc_feature (161)..(161): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
tcagagcactgtagcacgaccggtgctcgatttagcgtcgatctcagggggagtcagtcccagtcaggacacagcatggacatggagggtccccgctcagctcctggggctcctgctgctctggctcccaggtcgccagntgtgccatccagttcgacccngtctccatcctcctgtctgctatcgtggtggganacagngtcatcatctgtcgccggacaagtcagagttgttagttattttaattaattggtatctagttacaaacgagggtaacacccgtaagctcagacttctatgactnactattacctaagttttaacgaaacggttccggggtacctagtactaagtacttacgaggttcggactaggttacgggtataccggtagggactaggtacttacgcttcactacatcagtntactacaactgaatatttacgaacttactactttanactacgaactacgttagtaaccgaccttaccctccgttactccgttaccggttcggacgggtacgggtaaccgtagggtacggtaaagtccggtaaacgtaaccggaaccttaggaccggtacgttccggacctaacggttaccgtgttacccgttaccg

SEQ ID NO: 19062 - DNA, 680 bp, Homo sapiens
  misc_feature: GYAE6OF02IHSQ0.4.10.A10.1.454.CMB.1.raw
  modified_base (141)..(141): a, c, t, g, unknown or other
  misc_feature (141)..(141): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagagcactgtagcacgaccggtgctcgatttagcgtcgatctcgagggggagtcagtcccagtcaggacacagcatggacatgacgggtccccgctcagcctcctggggctcctgctgctctggctcccaggtgccagntgcgccatccagttcgaccctagtcctccntcctccctgtcctgccattcgtanaggagacagtntccactatcctgttcggccgggcctaagtcgaaggtcttattttacgtagtttattacgtcgtacggtatcgaacgtaaccgtaaaaacggtacggtaaaccgacccctaacggtacctcccgttagacttcgtagtacggtcgtctaactccttacgttacgtaacggtaacgggttccgggtacacgtaacgtacggtacgtaacgggcgtaggtacggtacgtacgtcgttaccggggaaattcgtaacgtttcccaacgttcctaaccgtaacgtactcgacgaacctcgtccaacgtacgtaccgttagtacgttagttactagttaaccttaagtactacgtacaaacttcgtagttaacctaagtcgactcgtacctaggtccgaggttaccgagtacggtacgtaacacgttaccggaaacgttacggttggacctacggtcgaaacccttcgtactttcggtaac

SEQ ID NO: 19063 - DNA, 581 bp, Homo sapiens
  misc_feature: GYAE6OF02HTVLA.4.10.A10.1.454.CMB.1.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcagggctattttcagttattgccgtggtatcagacaaaaacgaggaaacnccctaagctcctagatctagtggtncactcctactttagactaaggtcggtacccatcgaaggttcagcgacaggtggatcgtggactagtatttcactctcacatanacgcaagtcctagacgtcctagtaactatttcgaacttaactttatactgtaacaacgtagttaacttaaatacgttacgtccattacccgtaggtttaccgggacgggtaacgggtacctaaggggtacggaaacgtaacgtaacgtaaaaccgggtgttcgggtacggtactaccggaacctaaccgttacgttcgttaccgg

SEQ ID NO: 19064 - DNA, 556 bp, Homo sapiens
  misc_feature: GYAE6OF02F3XAX.4.10.A10.1.454.CMB.1.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatcctccctgtctgcatctatacggngacagagtcaccatcactgccgggcagtcagggcattttcagttattagcctgtatcagcaaaaacgnggaaancccctaagctacctgactctatggtgcatccactttgcaaagtggggtacccatcgaaggttcagcgcagtgacttgnggacaggattcgactcanacatcagccagcctacagccctaggaagtattttgaccttaattatcgtacgtaccaaacngtacttaaatacgttaacgccttactcgtaaccgtttcgggacggggaacggtacccgaagggtttagaacgtacttacgaaaaccggtaacgtcggttaggtaccttaggaccctaacgtacgttccgttaaccg

SEQ ID NO: 19065 - DNA, 754 bp, Homo sapiens
  misc_feature: GYAE6OF02GAS89.4.10.A10.1.454.CMB.1.raw
  modified_base (742)..(742): a, c, t, g, unknown or other
  misc_feature (742)..(742): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctccaggtgccagatgtgccatccagttcgacccagtctccatccctccctgtctgcatctagtaggagacagacgtccaccatccgtacttcggccgggccagtcgagggtctattttctagtttattacgccttggtatcaagaaccaaaaccgaagggaaacgtaccccgtaacgacctaccgtagtactcgtagtggtacgccgtactcctacgtttacgacgtaacggtacgggtaccctacgtacggtaacggttacgacggtacgggtacgtacggtcggtaacggtccggtacgggtaacgtaaggttacgtttaccgtacctacccgttacccgaaccttacgtaccgtacgaccttaaccggacccttaacgaaccgttacccgtaaggtaaccgtttacgttttaacggaacctttaacgtttaacctttacgttaaccgtaacgtaactaacggttaaaccttttaaacgtaacgtttacccgaccgttacgtttaacgtacccggtttaccggggacgggtaaccggtacggtacgggtaacggaacgttaaccgtaacggtaaacccggttagtaccgggtcggtaccttacggacctaaccgtnttaccgttccgg

SEQ ID NO: 19066 - DNA, 678 bp, Homo sapiens
  misc_feature: GYAE6OF02HOKLA.4.10.A10.1.454.CMB.1.raw
  modified_base (450)..(450): a, c, t, g, unknown or other
  misc_feature (450)..(450): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtcctccactccctccctgtctgctatctagtaggacgacagatcaccatccacgttcggccgggcagtcgagggtcttagttttctagtttatttacgtccgttggtactacgaacgaaccaaaaaccggacgggaaaccgaccctaagcctacctagtacttacgtagtcggtcactactcctacgtttagaacgtaacgggtccgggtacctagtacgtaacggttcgacggcggagtaggtggacgtcggtacgggaactagttactttcacgtacctacgaacctntacgacgactaaccgaccttacgacggtacctaaggtaatttacgtttacgaaccttaaactttagttaaccgtagtaacctaacgttaacgttaactttaaacgtaaccgtccggtaccgtccgtttaaccgttaccgggttacgggaccgggtaacggaccggtaaggtcggaacttaacgaacggtaaacgtcgtaggtacgcgtacgtacctactcgttactcg

SEQ ID NO: 19067 - DNA, 605 bp, Homo sapiens
  misc_feature: GYAE6OF02HQT14.4.10.A10.1.454.CMB.1.raw
  modified_base (369)..(369): a, c, t, g, unknown or other
  misc_feature (369)..(369): n is a, c, g, or t
tcagagcactgtagcacgaccggtgctcgatttagcgtcgatctcagggggagtcagtcccagtcaggacacagcatggacatgagggtccccgctcagctccgtggggcctcctgctgctctggctcccaggtgccagatgtgccatccagttgacccagtctcactcctcctgtctgcatctaataggacacagagtcaccatcacgttgccggaccagtccgagggctattttcagtttattacgccgtagtacacgtagactaaaaaacgcgggaaaccacctaaacgctaccgtagacttctaatggctactactcctactttagacgtaaggtcggtaccagtacgtaagtcaggcgataggngtactcgtagggactagtacgttacaactctaccgactacgtcacgcacgtcctaagacgtaccgtaaggtaacgttatttacgaacttaaacgtttacttaacgtacgtaaccaaacgtaacgttaacttaaacgtacgttaacgctaccgtactacggttacgacgggacgtacgtaaggtggaactactaacgaaacgtacgtggacgtccgagacctaacgtcgtagttacc

SEQ ID NO: 19068 - DNA, 632 bp, Homo sapiens
  misc_feature: GYAE6OF02F1VOQ.4.10.A10.1.454.CMB.1.raw
  modified_base (190)..(190): a, c, t, g, unknown or other
  misc_feature (190)..(190): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctatagganacagagtcaccatcactgccggcagtcagggctatttcagttattagccttggtatcagacaaaaaccgagggaaacgcccctaagctacctgatctagtgtgctatcctactttgactaaggtcgggtacctagtacgtaacggttcaggcggacgtaggtaggtactcggtacgggtactaggttactttcgaccttccgtcaacctagtaccaacggcctaacgtaccctaacgtaaccggtacccgtaaggaaactttacgtttaacggaccttaacgtttaactttactaggttaccaacgtacgtaactttaaagtaacttacgtcttactacctacggtttccgggacggtacgggtaccaagggtcggtaacgtaagtaacccgaaacgtaccgttaggtacggaccttacggacctaccgtacttacgttacg

SEQ ID NO: 19069 - DNA, 668 bp, Homo sapiens
  misc_feature: GYAE6OF02IKECJ.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccactcctccctgtctgcatctataggagacagagtccaccatctacttcggccgggccagtcagggctatttctagtttattacgctggtatcagaaccaaaaccgaggaaacgaccccgtaagtacctaccgtacgtactctagtggtcgctacttcctactttagacgtaacggtcggtacctagtacgtaacggtacgaggtcggacgtaggtaggacgtacggtacggggaactaacgttactttccaccttccgtacctaacctacgtaccacgaccaacgcctaacgacgtacgtaacgtaagttactttacgaccttaaactttacttaccgtacgtaactaacgtaagtaactttaacgtaacttaccgtaccgtaccttaaccgttacggtttaccgggacgggtaaacggggaccgtaaggggtacggtaacgtaacgtaaccgtaaacggtacgtaggtcggtacctacggacctactaccgttacgttaccg

SEQ ID NO: 19070 - DNA, 624 bp, Homo sapiens
  misc_feature: GYAE6OF02FI2QP.4.10.A10.1.454.CMB.1.raw
  modified_base (284)..(284): a, c, t, g, unknown or other
  misc_feature (284)..(284): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttcgacccagtctccatccctccctgtctgcatctataggagacagacgtcaccatcacgttcggccgggccagtcagggctattttcgagttattagccttggtactcaagaccaaaaaccgaggggaaacncccctaagccttcctgatactatggtcactatcctatttgactaaggtcgggtacccagtacgaaggttcaggcggacaggtgatcgtagggactagtactttcactcaccacgtatcgagacacgtcctaacgacgtacctagaaagttctttacgacttaaacttacttacgtagtaacctaaacgacgttactttaaagtacgttaccgccgttacctcgttaaaccggtttcgggaccgggtaacgggaccctaaaggggtcggtaaacgaacgtaacccgtaaaacggtacgttacggacgtaccgttaggacccaaccctagtacccgttaacg

SEQ ID NO: 19071 - DNA, 637 bp, Homo sapiens
  misc_feature: GYAE6OF02JGROB.4.10.A10.1.454.CMB.1.raw
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcacctatcacttcgccgggccagtcagggctattttcagtttattagcctggtactcganacaaaaccgagggaaacacccctaagcctcctagtactctagtcggtnactactcctactttagacgtaaaggtccgggtaccattacgacggttcgaggcgcacggtggactcggtaggggactaggtactttcgacttacctacaacctatcaaggtccacggtaccctaacgtaccgaccgttacggtaaacgtttcttttacggaacttaaacctttacgtttaactacggttaacctaacgaacgttactttaacgttaacttaaccggtccgtaccttacgttaccggttcggtaacgggtacggacgttaggagggtacgtactaaaccggaacgtacgtggtacggacgtccgactaccttagtcgttaccg

SEQ ID NO: 19072 - DNA, 657 bp, Homo sapiens
  misc_feature: GYAE6OF02I7OGE.4.10.A10.1.454.CMB.1.raw
  modified_base (535)..(535): a, c, t, g, unknown or other
  misc_feature (535)..(535): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttcgacccagtctccatcctccctgtctgcatctataggagacagacgtcaccatctacttcggccggccagtcgaggctattttcagttacttagcctggtatcagtaacaaaaccgaggaaactccctaagtcctcgtagacttactagtggtcacactacctacgtttagacgtaaacgggttcggggtacccctaagtaccgtaacggttcgacggtcggtaaccgtggtacgtacgtcggtaggaacctaggtactttcgaacctctacacgtactacgctaccgacgtacctaacacggtaccttaaggtaagtttacgtttacgaaccttaaacgttttactaaccgttacggtaacctaagtaccttaacgttttaanaaacgtttccgacgttacccttcggttaacccggttcgacgggtacgtaacgtaaggacgtaacgttaacaacgtaaacggtacgttcggacgttaccgtataccgtacgttagttcgtacg

SEQ ID NO: 19073 - DNA, 797 bp, Homo sapiens
  misc_feature: GYAE6OF02H908Q.4.10.A10.1.454.CMB.1.raw
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttcgacccagtctccactccctcctgtctagcatctagtaggagacagagtccacctatctacgttcggccggctagtacgacgggtcttattttcagtttacttacggtccgttggtactacacgaaccaaaaccggtacgggaaaccgtacccgtaaactccttaccgtagtaacgttcctaaggtcggtacgcctacttccgttaacgtttacggaacgtaacgggttccgggtaccctaagttacgtaacggtccgacggaccggtagtacggtaggtaccgtggtaccgggtaatacgtttacgttaccgtacctttacctaccgtaacctacgtacgaaccgtacgtacccgtaacccgtaacgtccgtaacccgttaaggttaaccgtttagtttaccgtaaacctttaaacgtttaccgtttacgtacgtttaacctaacggttaaagttaacccttttaaagtaccgttaccgtccgttacctttaccggtaaacccgggtttccggggaacgggtaaaccgggttaccggtaaacggggttacgtaacggtaaacccggtaaacggtaaaccgggttacggttacgggttaccgacggttacccggaacccttcggttaaccgttcgtttaacccgg

SEQ ID NO: 19074 - DNA, 746 bp, Homo sapiens
  misc_feature: GYAE6OF02F8EKD.4.10.A10.1.454.CMB.1.raw
  modified_base (271)..(271): a, c, t, g, unknown or other
  misc_feature (271)..(271): n is a, c, g, or t
  modified_base (734)..(734): a, c, t, g, unknown or other
  misc_feature (734)..(734): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccggccagtcagggctattttcagttattagccttggtatctagaacaaaaccgagggaacnccccgtaagcctaccgtagactacgtacgttggtcgactacgtccctaacttttcggaaccgtaaaacgggttccgggggtaccctaagttaccgtaaacggtttaccgaggccgggtactagggtacggtacgttacgtacggggtaactaagttacgttttaccacgtttaccctaccgtaaacccgtacgtaccgtaacgtaccgtaccgtaccctaacgtaccgtacgttaacggtaaacgtttacgttttacggacccttaaaacgttttaccgtttactacgtttaaccgaaaccttacggttaaactttaaacgttaaaccgtttaccgtaccgttaccttaccgttaaccggttttccggggaaccgggtaacgggtaccggtaaagggtcggtaacgtaacgttaaccggaaaacgttaaccggtaggtacggtaccgtacgacctaacccgtnttaccgttacgg

SEQ ID NO: 19075 - DNA, 689 bp, Homo sapiens
  misc_feature: GYAE6OF02G1KKK.4.10.A10.1.454.CMB.1.raw
  modified_base (95)..(95): a, c, t, g, unknown or other
  misc_feature (95)..(95): n is a, c, g, or t
  modified_base (196)..(196): a, c, t, g, unknown or other
  misc_feature (196)..(196): n is a, c, g, or t
tcagagcactgtagcacgaccggtgctcgatttagcgtcgatctcagggggagtcagtcccagtcaggacacagcatggacatgagggtccccgntcagctcctggggctcctgctgctcgtggctcccaggtgccagatgtgccatccagttgaccctagtctccattcccgtccctgtctgctatctatagganacgagacgtaccaccatctacttcggcccgggacagtcgaggtcttattttacagtttattacgccgtggtatacgaagaaccaaaaacgacggaaacgacccctaagacctcgtgtactcgtagtggtcactactacctagtttcgaacgtaaggtcgggtaccagtacgtaaggtcgacggtacggtacgaggtacgtacgtcggtacgggtaacgtagttacttaccgacttacctacgtaccagttacacgtacacgaccctacgacgtacgttaagtaagttactttacgaacttaaaccgtttacttaacgttcgtaaccgtaaacgttacgttaaactttaaacgtaaccgttaccgtaccgttccttaacccgttacggtttacccgggaacgggtaaccggtacgtaacgggttacggaaagtaaccgtaaccgaaacgttacggtaggtacggtaccacgtacccgtacgttacgtcttaccg

SEQ ID NO: 19076 - DNA, 755 bp, Homo sapiens
  misc_feature: GYAE6OF02FOE48.4.10.A10.1.454.CMB.1.raw
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtcgccatccagttcgacccagttcctccactccctccctgtctgctatactagtacggagacagagtccacatcctacgtcgccgggcacgtcgacgggctatttcagtttattagcctgtanacagaacaaaacagggaacnccctaagctaccagattctagtggtncgtactccacgtttcgaacgtaaggtccggggtacccagttacgtaacggtacgtacgggccggtacgtagggtggtacgttacggaggggtaacgtaacgtacgttttacctaaccgttcctaccgtaacccttaacgtccgtaacggtacccgaccggtaaccccgttaaccgtaaccgtaccggtaacgtaaacgtttacgttttaacgaaccgtttaaacgttttaaaccgttacgtttaaccgtaaccgtaaaccttaaaccgttaaacttttaaacgttaacgtttaaccggtacccggttaacctacccggtttaccgtttaaccggggaccggggggttaacgggaaccggtaaggtaccggggtaagtaaccggtaaccggtaaacgtaccggtaggtaccgtacgttacgtacccgaaccttacggtctttaccgg

SEQ ID NO: 19077 - DNA, 693 bp, Homo sapiens
  misc_feature: GYAE6OF02F9IPQ.4.10.A10.1.454.CMB.1.raw
  modified_base (291)..(291): a, c, t, g, unknown or other
  misc_feature (291)..(291): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttgacccagtctccatcctccctgtctgcatctataggagacagagtcaccatcacttgccggcagtcaggctatttcagttattagcctggtatcagacaaaaccgagggaaacgacccctaagctactgatctagtggtnacatccactttgacgtaaggtcgggtacccatacgaagttcgaggtcgcgtagtgatcgtagggactagtacttctacgtactaccaactactcgaagcctaacgtaccccgtaacacggtaccctaggtaacgtttacgttttacgaacctttaaacgttttactttaaccgttacgttaacctaacgtaacgttaaccttttaaaactttaaacgtttaaccggtacccgttacccgttaaccggtttaaccggtttttaccgggggaacgggtttaaaccggggaacccgttaaaggggtaccggaaaggttaacccgtaaaccgtaaaaccgggttaaccgttacgggttacggttaccgtacggtacccgtaacccgttacgttcccgtttaaccgg

SEQ ID NO: 19078 - DNA, 672 bp, Homo sapiens
  misc_feature: GYAE6OF02G0J2V.4.10.A10.1.454.CMB.1.raw
  modified_base (310)..(310): a, c, t, g, unknown or other
  misc_feature (310)..(310): n is a, c, g, or t
  modified_base (505)..(505): a, c, t, g, unknown or other
  misc_feature (505)..(505): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccaagttgacccagtctccatcctccctgtctgcatctataggagacagagtcaccatcacttgccgggccagtcgagggctattttcagtttattaggccttggtatcaagacaaaaaccgagggaaacaccccgtaagcctacctagtactcgtaagttggngtacctacttccgtacttttacggaacggtaaacgggttcggggtaccctaagttaccgtaaacgggtttcgaacgggtccggtacggtaaggttcggaacgttcggtaggggaactaggttactttaccaccgtttactaccaccgtatccgaagtccaccgtacctacacggtccttaagaagtttcgtttanaccttaactttattactacgtacaacgtacgttaacttaagtaacgttaccgacttaccttagttaccggttcgggacgggtaacggaccggtaagggtacggaacgtaacgtaaccgaaaacggttagttggtacgtcgttaccgacctaacgtacgttcttaccg

SEQ ID NO: 19079 - DNA, 733 bp, Homo sapiens
  misc_feature: GYAE6OF02FGVLU.4.10.A10.1.454.CMB.1.raw
  modified_base (708)..(708): a, c, t, g, unknown or other
  misc_feature (708)..(708): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatcctacgttcgaccctagtcctaccactccctccgtgtcgtgcatctagtaggacgacagacgtccaccatcgtacgttcggccggcagtccgagggtccttagtttacgtagtttattacggtccgtacggtataccgaacgaaccgtaaaaaccggtaaccgggaaaccgtaccccgtaacgtacccttacccgtgtaaccgtactttacggtaggtccgaccgtactacccgtacgttttaccgaacgttaacgggtaccggggtacctaacgtacgtaacggtacacggtcgggactacggtacggtagtcggaaggacgtacgtacgttactaccgtccgtacaccgtaatccgaaccgacgtacccgtccgtaaacgcggttaccgtaacggtaacgtttcggtttaaccaacgtttaacttaaccgttcgtacgttaacaacgttagttaacttaacgtacgtttacgtccgttactaccggttacgtccggggaacggtacggtaacgagggttacgaacgtaacggtaaccgaacgttacgacgggtctaaccgnggtaaccctacgtgttcccttacgg

SEQ ID NO: 19080 - DNA, 134 bp, Homo sapiens
  misc_feature: GYAE6OF02HEW62.4.10.A10.1.454.CMB.1.raw
  modified_base (97)..(97): a, c, t, g, unknown or other
  misc_feature (97)..(97): n is a, c, g, or t
  modified_base (120)..(134): a, c, t, g, unknown or other
  misc_feature (120)..(134): n is a, c, g, or t
tcagagcactgtagcacgaccggtgctcgatttagcgtcgatctcgagggggagtcagtcccagtcaggacacagcatggacatggagggtccccgntcagctcgtgggctctgctgctnnnnnnnnnnnnnnn

SEQ ID NO: 19081 - DNA, 752 bp, Homo sapiens
  misc_feature: GYAE6OF02IJQ2Q.4.10.A10.1.454.CMB.1.raw
  modified_base (96)..(96): a, c, t, g, unknown or other
  misc_feature (96)..(96): n is a, c, g, or t
  modified_base (199)..(199): a, c, t, g, unknown or other
  misc_feature (199)..(199): n is a, c, g, or t
  modified_base (576)..(576): a, c, t, g, unknown or other
  misc_feature (576)..(576): n is a, c, g, or t
tcagagcactgtagcacgaccggtgctcgatttagcgtcgatctcgagggggagtcagtcccagtcaggacacagcatggacatgagggtccccgntcagctcgtgggctcctgctgctcgtggcctcccgaggtcgccagatgtcgaccatccgagttcgaccctagtcctacctacgtcccttccctgtctgacctntacgtatagggacacaggtactacctaccattcgtacgttcggcccgggtactacggtcgaagggtccttaagttttaccgtagtttacgttacgtacggttagttacgtaacgaacgaaaccggtaaaaaaccggacgggtaaaacccgtacccttaaacgtccgttaccgttaacgtacgttaacggttacgtacggtacgtcctacgtttacccgtacgtttacggaacgtaacgggttccggtacctaacgtaaggtacgtacgtacggccggtagtaggtacgtcgtacggtaacggacttcgttaaccttaccgactaccgacctactacgtacgaacgcgtacgacgtacgacgtacgtaagtaactttnttacgtacttacgttaacttactacgtaacgtaacgtaacttaagttaaccgtaacgttccgtacttacgttacgttaccgggtacggtacgggtaacgtcggtaaggtacgaacgttaaccgacgtaaacggtcgtacggttcgacgttcgaacctttacgtccgttagttaccg

SEQ ID NO: 19082 - DNA, 632 bp, Homo sapiens
  misc_feature: GYAE6OF02IU1D1.4.10.A10.1.454.CMB.1.raw
  modified_base (264)..(264): a, c, t, g, unknown or other
  misc_feature (264)..(264): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggcatttcagttattagcctggtatcagcaaaaccagggaaancccctaagcctcctgactctatggtgcatccactttgcaaagtcggggtaccatcaaggttcagcggcaggtggatcgtagggacagactttcgactctcaccatcagcagtcctacgacgacctagtaacgtattttacgacttaaacgtttattaccttacggttactaaacctaggtaaccttttaaagtaaacttttaccggacgtaccttaccgtaccgtttttaccgggggccgggttaacggggacccgttaaagggggttaccgggtaagggtaaaccgttaacgtaaaaacccggtaaccggtttagggttacgggaccgtttacggacccgtaacccgtacgttcccgttttaccggg

SEQ ID NO: 19083 - DNA, 711 bp, Homo sapiens
  misc_feature: GYAE6OF02HSV60.4.10.A10.1.454.CMB.1.raw
tcagagcactgtagcacgaccggtgctcgatttagcgtcgatctcaggggggagtcagtcccagtcaggacacagcatggacatgagggtccccgctcagctcctggggctcctgctgctctggctcccaggtgccagatgtcgccatccagttcgacccagtcctccatccctcctgtctgctatctagtaggagacagagtacaccatcacgtcggccgggccagtcgaggcttattttcgtagtttacgtttagccgttaggtactacgaacgaaccgaaaaaaccggaacggggaaaaccaccccgttaaacgtcccttacctaggtaacttcgttagttggtacgactaccgttcctacgttttacgaacggtaacgggttccgggtacctaagtacggtaacggttcgacgggtcggacgtaaggttggacgtacgggtagggaactacgttactttaccgaccttcctacaccgtagtaccaacgtcaacgtacctacgacgtacctaagtaacgtttctttacgaactttaactttataccttaacgacaacttaacgttaaactttaactaacgttacacgttacctttacggtacggttaccgggaacgggtacgggtaccgtaggggtaagtacggtaaccgtaaacgaaaccggtaggtcggtacggaccctcggtaccctaacgtccgttcttaccgg

SEQ ID NO: 19084 - DNA, 941 bp, Homo sapiens
  misc_feature: GYAE6OF02HI4LL.4.10.A10.1.454.CMB.1.raw
tcagagcactgtagcacgaccggtgctcgatttagcgtcgatctcgagggggagtcagtcccagtcaggacacagcatggacatgacgggtccccgctcagctccgtggggctcctgctgctcgtggcctcccaggtcgaccagatgtcgccatccagttcgaccctagtcctacctactccctccctgtcctcgactacttctaagtaggtacaacgaggacgtaccaacctattcctaaccggttcggacccgggtacctaacggtcggtaaggtaccttacgttttacgtacggttttaacgttacggtccgttaagggtacttaaccgaacggtaaaccctaaaaaaccgggtaaccgggtaaaacccgtacccccgtaaacggtacccttaaccgttagtaaccttaccggtttacggtacggtacgtacctaccgttaacccgtttaccgttacggaaaccggttaacgggtaccccggggtaactaccggtaacgtaaccgggttccggaaacggttccgggtaaccgtagggtacccggaaggttaccggtaacgggtacgttaaccggttaaccgtttaccctacggtttcctaacccgtaaccgtaagtacccggtaaccgtaccgtaaccgggtaccctaacggtaccggttaacgtaagggttaccgtttaacgttaacccggtttaacgtttaaaccgtttacccgtttaacgtaccggttaaacccttaacggttaaaccgtttaaccgttttaaaacgttaccggttaccccgttacgttaacccgttaacccgttacgggttacccgggaacccgggttagggaacccggtaagggtaccggtaaacgaccggtttaaacggaaaccggttcgggttaacgtaccggtaccgtaccgaccgtttaaccgttcgttaccgttaccg

SEQ ID NO: 19085 - DNA, 788 bp, Homo sapiens
  misc_feature: GYAE6OF02FOWKB.4.10.A10.1.454.CMB.1.raw
tcagagcactgtagcacgaccggtgctcgatttagcgtcgatctcgagggggagtcagtcccagtcaggacacagcatggacatgagggtccccgctcagctccgtggggctccgtgctcgctcgtggctcccgaggtgccgagatgtcgccatccgagttgacccagtcctccacttccctcccgtgtctgacctatactagtaggacgtacaggacgtacaccgtatccgtacgttcggcccgggtacctaggtcgtaacgggtcttaacgttttacgttaaggtttacgtttaacgtaccgttcggtaactaccgtaaacggtaaacccgtaaaaaacccggaacgggtaaaacccggtacccccgtaaacggtcccgttacccgtagtacgttaccgtaagttcgggtctacgtacttaccgtacgtttacgacgtaacggtcggtacctacgtacgtaacggttccaggcggtacggtacgtacgggtactcggtaggacgtagttaccttaccgtaccttaccgtactacctacgtaccgacgtaccgtaacgtaccgtcctaaaaaaaaaccgtcgtaacgtaacgtttacgtttacgtacttaactttacgttaacgtacgtaacctaacgtacgtaacgttaccgtacccttacccgtcccgttaccgtaccgttaccggttaccgggtacggtaccggtacggtacggtacggtaacgtaacggtaacgtaaacgtacggtacggtacgcggtacgtacgtaccgtacgtcgttaccg

SEQ ID NO: 19086 - DNA, 764 bp, Homo sapiens
  misc_feature: GYAE6OF02GOIWD.4.10.A10.1.454.CMB.1.raw
  modified_base (189)..(189): a, c, t, g, unknown or other
  misc_feature (189)..(189): n is a, c, g, or t
  modified_base (296)..(296): a, c, t, g, unknown or other
  misc_feature (296)..(296): n is a, c, g, or t
tcagagcactgtagcacgaccggtgctcgatttagcgtcgatctcagggggagtcagtcccagtcaggacacagcatggacatgagggtccccgctcagctcctgggctcctgctgctctggctcccaggtgccagatgtgccatccagttcgacccagtctccatcctcctgtctgcatctatagganacagagtacaccatcacttcggccggacagtcgagggtactagttttacgagtttatttacgcgttaggttactcgtaaacgaccaaaaaaccgacgggtaaaaccnccccgttaaagtcccttaacccgtagtacgttacctagttcggacgtcctaacgttacccgttacgtttacggacgttaaacggttcgggggtacccttaaataccgtaaacggttccgaaggtccggaacgtaaggtcggtatccgtaacggggaacctagttagtttacccaactacttaccgaccgtaactaccgaagtaccgtacgtacccttaacgtaccgtaccggttaacgaaacgttttagtttaccgtaacccttaagttttaccgttacgtaaccttaacccgtaaacttaacgtttaacctttaaagtaaccctttacggtacccttaacgttacgtaccggtttaaccggggaccggttaacggtaccgaagggtttccgaaagttcccgttaaaacggaaaaccgtttcggtagtaccggttaaccgtaggtaccccaaggttccgttcgtaccg

SEQ ID NO: 19087 - DNA, 584 bp, Homo sapiens
  misc_feature: GYAE6OF02FG09F.4.10.A10.1.454.CMB.1.raw
  modified_base (269)..(269): a, c, t, g, unknown or other
  misc_feature (269)..(269): n is a, c, g, or t
tcagagcactgtagcacgaccggtgctcgatttagcgtcgatctcgagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggcagtcagggctatttcagttattagcctggtatcagacaaaaacgagggaaacncccctaagcctacctgatactagtggtgcactcctacgtttagacgtaaagggtcggggtacccaagtaccgtaaggttcaacggtcggactaggtacggacgttcgtagggtaacctaggtactttcacctcacaacctatcagcgtacgcctaacgacgtacctagtaacgttattttcgacttaactttacttactagtacaactagtactttaaataacttacgcgtctacgtacggttcgggacggtacggacgtaagggtgaagtactacgaaacgtagtggtacggctacgacctacctagttcgtcg

SEQ ID NO: 19088 - DNA, 879 bp, Homo sapiens
  misc_feature: GYAE6OF02GKTPP.4.10.A10.1.454.CMB.1.raw
  modified_base (196)..(196): a, c, t, g, unknown or other
  misc_feature (196)..(196): n is a, c, g, or t
tcagagcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtcctaccattccctccctgtctcgcatctagtagganacagacgtccaccatcacttcggccggccagtcgaggtctatttcagttattacgtctaggtactacaacgaaccgaaaaaccgacgggaaacctaccccgtaagcccgttaccgtagtaacgttactacgtcggtactactaccttacccgttacgttttacgaacggttaaacgggtcccgggggttaccctaacggttaccgttaacggtttaccggacgggtaccgggtacggtacgggttagggttacgttaccgggtagggtaacccgttaaggttaaccttttaaccctaccgtttacccgttaaccctaacccgttacgttaaccggacggtacccggtaaacccgtaccccgtaaacgtaccgttaccggttaaaggtaaccgttttaacttttaccgggaaaccttttaaccgttttaaccttaaccggttaaccgttaaccgtaaaccgttaaaccgggtttaaactttaaaacgttaaccggtttaacccgtacccgtttaccggttacccgtttaaccggtttaccggggtaaccgggggttaaccgggttaaccggtaacggggttacggtaaacggttaaacccgttaaacccgggtaaaccggttaccgggttacgttacgggtaccggttacccgacccgtttaaccgtacgtttaccgtaaccgg

SEQ ID NO: 19089 - DNA, 844 bp, Homo sapiens
  misc_feature: GYAE6OF02H75RJ.4.10.A10.1.454.CMB.1.raw
  modified_base (120)..(120): a, c, t, g, unknown or other
  misc_feature (120)..(120): n is a, c, g, or t
  modified_base (201)..(201): a, c, t, g, unknown or other
  misc_feature (201)..(201): n is a, c, g, or t
tcagagcactgtagcacgaccggtgctcgatttagcgtcgatctcgagggggagtcagtcccagtcaggacacagcatggacatgagggtccccgctcagctcctgggctcctgctgctntggctcccaggtgccagatgtgccatccagttcgaccctagtctcctacgtccctccctgtctgcctatactagtacgganaaccgagacgtacacctactacacgttcggcccggacgaggtacgaggtccttacgttttacgtagtttactttacgccgttacggtatacgaacgaaaccgtaaaaaccggaacggggtaaacccgtaccccgtaaacgtcccgttacctcgtaacttcgtaagtgggtcgtactacgttaccctaacgtttacgaacggtaaacgggttaccggggtacctaacgtacggttaacgttacgagggtcggtacgtaggtacggtacgtaccgtaggggtaactaacgttaccgttacacctttacctacccgaactcgtacgaaccgtaccgtaacctaccgtagaacccggttccgtaaaggttaaccgtttaacgttttacggtaaaccccgtttaaagttttaaccgttttacgttaaccgtaaaccgttaaaccttaacgttttaaaccgtttaacttaaaccgggttccgtaccgtttacccttacgggtttacccggttaaacggggtacccgggttaacgggtaaccggtttaaacgggggaccgtaacgttaaaaccggttaaccggaaacccgttaacggtacgggttaccggtacgtaccggtaaccccctataccggttaaccgttttccg

SEQ ID NO: 19090 - DNA, 714 bp, Homo sapiens
  misc_feature: GYAE6OF02GLNZX.4.10.A10.1.454.CMB.1.raw
  modified_base (656)..(656): a, c, t, g, unknown or other
  misc_feature (656)..(656): n is a, c, g, or t
tcagagcactgtagcacgaccggtgctcgatttagcgtcgatctcgagggggagtcagtcccagtcaggacacagcatggacatgacgggtccccgctcacgctccgtggggctcctgctgctcgtggctccccgaggtcgccagagtgtcgccatccgaagttccgaaccctcgtcctccacttccctcctgtcctgactactcgtagtaggacacgagactaccactactccgtcgttaccggccggaccgtaggccggtaacggctttactttacgttacgttaacgtttacgtccgtaggttaactaccgtaaagaaaccggaaaaaccgaaggggaaccctaccccgtaacgtcctacgtcgtacttacgtacgtggtccactacttacgtacttacggaaccgttaacggtaccggtcctaacggtcgtacgtacgaccgcggtactagggcgttaacgtgtaacgacttaaggtacttacactttcaccgttacatacgactaccgacgtcctaaccgacgtaccgtaagtaacgtttcgttaactaaccgttaacttaccgttaacgtactaaccgaacgttaacttattaaacgttacgtaacctcgtacctaaccgttaggtaccgggagtaccggaggtaaacgnggtaaactaacgtaacggacgtaacgtcgacgtcgtacgactacgttacgtccttacg

SEQ ID NO: 19091 - DNA, 810 bp, Homo sapiens
  misc_feature: GYAE6OF02HMTC2.4.10.A10.1.454.CMB.1.raw
  modified_base (96)..(96): a, c, t, g, unknown or other
  misc_feature (96)..(96): n is a, c, g, or t
  modified_base (560)..(560): a, c, t, g, unknown or other
  misc_feature (560)..(560): n is a, c, g, or t
  modified_base (805)..(805): a, c, t, g, unknown or other
  misc_feature (805)..(805): n is a, c, g, or t
tcagagcactgtagcacgaccggtgctcgatttagcgtcgatctcgagggggagtcagtcccagtcaggacacagcatggacatgagggtccccgntcagctcgtgggctcctgctgctctggctccgaggtcgccagatgtcgaccatccgagttcgacccagtcctccactccgtcctgtctgactatactagtaggacgacgtaagacgtcaccgtactacgtacgttcggacccggactaggtccgaggtacttacgtttaccgtaagttttacgttacggtccgttaggtaacttacgaaccgaaaccgtaaaaaccggtaacgggtaaaccgtaccccgtaaacggtaccgttacctagttaacttacggttaacggcggttaccgtaacctaccgttacccgtttaacgtttaacggaaggttaaaccgggtccgggttaaccctaagttaccggtaacggtttacgacggaccgggtacgttaaggtcgtaacgtccggtaacggtaacgtacgtttaaccgtccgtaactttacccgtacctaaccgttanaaccggtacgtaccgtaaccgacccttaacggaaccggttacttaaccggttaatttaacgtttaaccgtaacttaaacgtttacgttaagtaccgtaacgtaaaccgtttaacgttaatttaaaccgttacgtccttaaccgtacgttacggtacgttcggggaacgtaaccgggtacgtaacggtgtaaactaaccggaacgtaacgtacgtttaggcgttacgtaccgccttacgtacgttntaccg

SEQ ID NO: 19092 - DNA, 611 bp, Homo sapiens
  misc_feature: GYAE6OF02G038P.4.10.A10.1.454.CMB.1.raw
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (584)..(584): a, c, t, g, unknown or other
  misc_feature (584)..(584): n is a, c, g, or t
tcagagcactgtagcacgaccggtgctcgatttagcgtcgatctcgagggggagtcagtcccagtcaggacacagcatggacatggacgggtccccgctcagctccgtggggcttcctgctgctctggctcccaggtcgccaggatgtcgccatccaagttcgacccngttccnccatccctccgtnctgcctatctagagganaccagactccacactcncgtcgccgggaccngtcgacggttctatttctaagtttacgttagccgttaggtaattcgaaacgaaaccgaaaaacggtaacgggaaacctccccgaggaccttccagtaacgtnttacggtagtcactaactcgtacgttnaacggtaggttccggctactacggtaacgtcgacggtgngtagtgacttgacggattatcttacncatacacgtncagacacgtacacgtctacagttaagttcttaacgtcttaacttagttacgataagtaactacgtaattaaactagactacctgtaccttacggtcggacggaccgttagacggttacggaataccgtaacgaacggtgtaccgngtaacgcctacggtctacgttctaccg

SEQ ID NO: 19093 - DNA, 777 bp, Homo sapiens
  misc_feature: GYAE6OF02I7JXK.4.10.A10.1.454.CMB.1.raw
  modified_base (188)..(188): a, c, t, g, unknown or other
  misc_feature (188)..(188): n is a, c, g, or t
tcagagcactgtagcacgaccggtgctcgatttagcgtcgatctcaggggggggtcagtcccagtcaggacacagcatggacatgacgggtccccgctcagctccgtggggctcctgctgctctggcctcccgagggtcgccagatggtcgccatccagttcgacccagtctccatccctccctgtcngctatctagtaggagacagacgtcaccatcctacgttcggccgggaccaggtccgagggtacttacttttacgtagtttactttaggccttaggttataccgtaacggtaaaccaaaaaaccggaaggggaaaacccgtacccccgtaaaggtcccttacccgttaggaacttaccgttaggtcggtcactacttaccttacgtttcgaacggtaagggttccggtaccctaacgttacggtaacggttaccgacgggtccggtacgtaggtacggtacgttacggtacgggaacgttacgttaacgtttacctaccgttacctacccgtaacctacgtaccgacgtaccctacgtaccctaagtaccgtacccgttaaggttaacttacgttttaacgactttaaacgtttacttacgttaacgtaccaaacgttagttaaccttaaacgttacgttacgaccgtttactaccgtttaccgggtaacggacgggttaaccgggtaacggtagggtagtaaccggtaacgtaaccgtaaaccggtcgtacggtaggtcgtacgtaccgtactcggtttacctacgttcc

SEQ ID NO: 19094 - DNA, 210 bp, Homo sapiens
  misc_feature: GYAE6OF01BLRDT.21.62.F07.1.454.CMB.1.raw
  modified_base (209)..(210): a, c, t, g, unknown or other
  misc_feature (209)..(210): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtttcacaagatttgggctctgggcacagcggccctgggctgcctggtcaaggactacttccctcgtctctactgagcgggctggcaaggcgcatagnn

SEQ ID NO: 19095 - DNA, 210 bp, Homo sapiens
  misc_feature: GYAE6OF01C0YX4.21.62.F07.1.454.CMB.1.raw
  modified_base (208)..(210): a, c, t, g, unknown or other
  misc_feature (208)..(210): n is a, c, g, or t
tcagtcgtcgctcgcacgaccggtgctcgatttagtagtcgcataaagggaagggaagactgacggtcctcccaggagttcaggtgctggcaccgtgggcatggggaggtgtgtcacaagatttgggctctgggcacagcggccctgggctgcctggtcaaggactacttccctcgtctctactgagcgggctggcaaggcgcatagnnn

SEQ ID NO: 19096 - DNA, 211 bp, Homo sapiens
  misc_feature: GYAE6OF01BGVPE.21.62.F07.1.454.CMB.1.raw
  modified_base (209)..(211): a, c, t, g, unknown or other
  misc_feature (209)..(211): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctgggctgcctggtcaaggactacttccctcgtctctactgagcgggctggcaaggcgcatagnnn

SEQ ID NO: 19097 - DNA, 213 bp, Homo sapiens
  misc_feature: GYAE6OF01ESDTF.21.62.F07.1.454.CMB.1.raw
  modified_base (209)..(213): a, c, t, g, unknown or other
  misc_feature (209)..(213): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctgggctgcctggtcaaggactacttccctcgtctctactgagcgggctggcaaggcgcatagnnnnn

SEQ ID NO: 19098 - DNA, 210 bp, Homo sapiens
  misc_feature: GYAE6OF01BIME6.21.62.F07.1.454.CMB.1.raw
  modified_base (207)..(210): a, c, t, g, unknown or other
  misc_feature (207)..(210): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctggctgcctggtcaaggactacttccctcgtctctactgagcggctggcaaggcgcatagnnnn

SEQ ID NO: 19099 - DNA, 212 bp, Homo sapiens
  misc_feature: GYAE6OF01ESQOL.21.62.F07.1.454.CMB.1.raw
  modified_base (209)..(212): a, c, t, g, unknown or other
  misc_feature (209)..(212): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctgggctgcctggtcaaggactacttccctcgtctctactgagcgggctggcaaggcgcatagnnnn

SEQ ID NO: 19100 - DNA, 218 bp, Homo sapiens
  misc_feature: GYAE6OF01DGNC5.21.62.F07.1.454.CMB.1.raw
  modified_base (211)..(218): a, c, t, g, unknown or other
  misc_feature (211)..(218): n is a, c, g, or t
tcagtcgtcgctcgcacgaccggtgctcgatttagtagtcgcataaagggaagggaagacgtgacggtcctcccaggagttcaggtgctgggcaccgtgggcatggggaggtgtgtcacaagatttgggctctgggcacagcggccctgggctgcctggtcaaggactaccttccctcgtctctactgagcgggctggcaaggcgcatagnnnnnnnn

SEQ ID NO: 19101 - DNA, 231 bp, Homo sapiens
  misc_feature: GYAE6OF01D2JGL.21.62.F07.1.454.CMB.1.raw
  modified_base (175)..(175): a, c, t, g, unknown or other
  misc_feature (175)..(175): n is a, c, g, or t
  modified_base (208)..(231): a, c, t, g, unknown or other
  misc_feature (208)..(231): n is a, c, g, or t
tcagtcgtcgctcgcacgaccggtgctcgatttagtagtcgcataaagggaaggggaagactgacggtcctccaggagttcaggtgctgggcaccgtgggcatggggaggtgtgtcacaagatttgggctctgggcacagcggccctgggctgcctggtcaaggactacttcccngtctctactgagcgggctggcaaggcgcatagnnnnnnnnnnnnnnnnnnnnnnnn

SEQ ID NO: 19102 - DNA, 277 bp, Homo sapiens
  misc_feature: GYAE6OF01CS0K0.21.62.F07.1.454.CMB.1.raw
  modified_base (216)..(220): a, c, t, g, unknown or other
  misc_feature (216)..(220): n is a, c, g, or t
  modified_base (222)..(277): a, c, t, g, unknown or other
  misc_feature (222)..(277): n is a, c, g, or t
tcagtcgtcgctcgcacgaccggtgctcgatttagtagtcgcataaagggaagggggaaggactgacgggtccctcccaggagttcaggtgctgggcaccgtgggcatggggaggtgtgtcacaagattttgggctctgggcacagcggccctgggctgcctggtcaaggactacttccctcgtctctactgagcgggctgggcaaggcgcatagnnnnnannnnnnnnnnnnnnnnnnnnnnnnnnnnnnnnnnnnnnnnnnnnnnnnnnnnnnnn

SEQ ID NO: 19103 - DNA, 213 bp, Homo sapiens
  misc_feature: GYAE6OF01D2B1L.21.62.F07.1.454.CMB.1.raw
  modified_base (210)..(213): a, c, t, g, unknown or other
  misc_feature (210)..(213): n is a, c, g, or t
tcagtcgtcgctcgcacgaccggtgctcgatttagtagtcgcataaagggaaggggaagactgacggtcctcccaggagttcaggtgctgggcaccgtgggcatggggaggtgtgtcacaagatttgggctctgggcacagcggccctgggctgcctggtcaaggactacttccctcgtctctactgagcgggctggcaaggcgcatagnnnn

SEQ ID NO: 19104 - DNA, 215 bp, Homo sapiens
  misc_feature: GYAE6OF01DAZNY.21.62.F07.1.454.CMB.1.raw
  modified_base (211)..(215): a, c, t, g, unknown or other
  misc_feature (211)..(215): n is a, c, g, or t
tcagtcgtcgctcgcacgaccggtgctcgatttagtagtcgcataaagggaaggggaagactgacggtcctcccaggagttcaggtgctgggcaccgtgggcagtggggaggtgtgtcacaagatttgggctctgggcacagcggccctgggctgcctggtcaaggactacttccctcgtctctactgagcgggctggcaaggcgcatagnnnnn

SEQ ID NO: 19105 - DNA, 217 bp, Homo sapiens
  misc_feature: GYAE6OF01C2GQT.21.62.F07.1.454.CMB.1.raw
  modified_base (211)..(217): a, c, t, g, unknown or other
  misc_feature (211)..(217): n is a, c, g, or t
tcagtcgtcgctcgcacgaccggtgctcgatttagtagtcgcataaagggaaggggaagactgacggtcctcccaggagttcaggtgctgggcaccgtgggcagtggggaggtgtgtcacaagattttgggctctgggcacagcggccctgggctgcctggtcaaggactacttccctgtctctactgagcgggctggcaaggcgcatagnnnnnnn

SEQ ID NO: 19106 - DNA, 269 bp, Homo sapiens
  misc_feature: GYAE6OF01DZS0F.21.62.F07.1.454.CMB.1.raw
  modified_base (221)..(222): a, c, t, g, unknown or other
  misc_feature (221)..(222): n is a, c, g, or t
  modified_base (225)..(269): a, c, t, g, unknown or other
  misc_feature (225)..(269): n is a, c, g, or t
tcagtcgtcgctcgcacgaccggtgctcgatttagtagtcgcataaagggtaaggggaaggactgacggtcctcccgaggagttcaggtgctgggcaccgtgggcatgggggaggtcgtgtcacaagattttgggctcctgggcacagcggccctgggcctagccctggtcaaggactacttccctcgtctctactgacgcgggctggcaaggcgcatagnncannnnnnnnnnnnnnnnnnnnnnnnnnnnnnnnnnnnnnnnnnnnn

SEQ ID NO: 19107 - DNA, 287 bp, Homo sapiens
  misc_feature: GYAE6OF01EG3O8.21.62.F07.1.454.CMB.1.raw
  modified_base (219)..(222): a, c, t, g, unknown or other
  misc_feature (219)..(222): n is a, c, g, or t
  modified_base (224)..(225): a, c, t, g, unknown or other
  misc_feature (224)..(225): n is a, c, g, or t
  modified_base (227)..(287): a, c, t, g, unknown or other
  misc_feature (227)..(287): n is a, c, g, or t
tcagtcgtcgctcgcacgaccggtgctcgattttagtagtcgcataaagggaagggggaaaggactgacggtcctcccaggagttcgaggtgctggggcaccgtgggcatgggggaggtgtgtcacaagatttgggctctgggcacagcggccctgggctgcctggtcaaggctacttccctcgtcctcgtactgagcgggctggcaaggcgcactagnnnngnngnnnnnnnnnnnnnnnnnnnnnnnnnnnnnnnnnnnnnnnnnnnnnnnnnnnnnnnnnnnnn

SEQ ID NO: 19108 - DNA, 217 bp, Homo sapiens
  misc_feature: GYAE6OF01ATXFL.21.62.F07.1.454.CMB.1.raw
  modified_base (204)..(204): a, c, t, g, unknown or other
  misc_feature (204)..(204): n is a, c, g, or t
  modified_base (210)..(217): a, c, t, g, unknown or other
  misc_feature (210)..(217): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctgtctctactgagcgggctggcaaggcncatagnnnnnnnn

SEQ ID NO: 19109 - DNA, 210 bp, Homo sapiens
  misc_feature: GYAE6OF02IFTI8.21.62.F07.1.454.CMB.1.raw
  modified_base (209)..(210): a, c, t, g, unknown or other
  misc_feature (209)..(210): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctgggctgcctggtcaaggactacttccctcgtctctactgagcgggctggcaaggcgcatagnn

SEQ ID NO: 19110 - DNA, 212 bp, Homo sapiens
  misc_feature: GYAE6OF02F1BWQ.21.62.F07.1.454.CMB.1.raw
  modified_base (209)..(212): a, c, t, g, unknown or other
  misc_feature (209)..(212): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaagatttgggctctgggcacagcggccctgggctgcctggtcaaggactacttcccgagcgacgactgagcgggctggcaaggcgcatagnnnn

SEQ ID NO: 19111 - DNA, 214 bp, Homo sapiens
  misc_feature: GYAE6OF02H2Z4W.21.62.F07.1.454.CMB.1.raw
  modified_base (209)..(214): a, c, t, g, unknown or other
  misc_feature (209)..(214): n is a, c, g, or t
tcagtcgtcgctcgcacgaccggtgctcgatttagtagtcgcataaagggaagggaagactgacggtcctcccaggagttcaggtgctgggcaccgtgggcatggggaggtgtgtcacaatatttgggctctgggcacagcggccctgggctgcctggtcaaggactacttccctcgtctctactgagcgggctggcaaggcgcatagnnnnnn

SEQ ID NO: 19112 - DNA, 234 bp, Homo sapiens
  misc_feature: GYAE6OF02F9HHG.21.62.F07.1.454.CMB.1.raw
  modified_base (214)..(234): a, c, t, g, unknown or other
  misc_feature (214)..(234): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggatgccctaggtcaaggactacttccctggtctctactgagcgggctcggcaaggcgcatagnnnnnnnnnnnnnnnnnnnnn

SEQ ID NO: 19113 - DNA, 211 bp, Homo sapiens; identical to SEQ ID NO: 19096
  misc_feature: GYAE6OF02IVJJ4.21.62.F07.1.454.CMB.1.raw
  modified_base (209)..(211): a, c, t, g, unknown or other
  misc_feature (209)..(211): n is a, c, g, or t

SEQ ID NO: 19114 - DNA, 242 bp, Homo sapiens
  misc_feature: GYAE6OF02I6FKP.21.62.F07.1.454.CMB.1.raw
  modified_base (212)..(242): a, c, t, g, unknown or other
  misc_feature (212)..(242): n is a, c, g, or t
tcagtcgtcgctcgcacgaccggtgctcgatttagtagtcgcataaagggaaggggaagactgacggtcctcccaggagttcaggtgctgggcacccgtgggcatggggaggtgtgtcacaagatttgggctctgggcacagcggccctgggctgccttggtcaaggactacttccctcgtctctactgagcgggctggcaaggcgcatagnnnnnnnnnnnnnnnnnnnnnnnnnnnnnnn

SEQ ID NO: 19115 - DNA, 212 bp, Homo sapiens
  misc_feature: GYAE6OF02H4NE2.21.62.F07.1.454.CMB.1.raw
  modified_base (210)..(212): a, c, t, g, unknown or other
  misc_feature (210)..(212): n is a, c, g, or t
tcagtcgtcgctcgcacgaccggtgctcgatttagtagtcgcataaagggaagggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnn

SEQ ID NO: 19116 - DNA, 238 bp, Homo sapiens
  misc_feature: GYAE6OF02HG2W8.21.62.F07.1.454.CMB.1.raw
  modified_base (216)..(238): a, c, t, g, unknown or other
  misc_feature (216)..(238): n is a, c, g, or t
tcagtcgtcgctcgcacgaccggtgctcgatttagtagtcgcataaagggaaggggtaaggactgacggtcctcccaggagttcaggtgctgggcaccgtgggcagtcgggggaggtgtgtcacaaggatttgggctctgggcacagcggccctgggctgcctggtcaaggactacttccctcgtctctactgagcgggctggcaaggcgcatagnnnnnnnnnnnnnnnnnnnnnnn

SEQ ID NO: 19117 - DNA, 212 bp, Homo sapiens; identical to SEQ ID NO: 19115
  misc_feature: GYAE6OF02GWXF8.21.62.F07.1.454.CMB.1.raw
  modified_base (210)..(212): a, c, t, g, unknown or other
  misc_feature (210)..(212): n is a, c, g, or t

SEQ ID NO: 19118 - DNA, 214 bp, Homo sapiens
  misc_feature: GYAE6OF02G4OS4.21.62.F07.1.454.CMB.1.raw
  modified_base (211)..(214): a, c, t, g, unknown or other
  misc_feature (211)..(214): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnn

SEQ ID NO: 19119 - DNA, 260 bp, Homo sapiens
  misc_feature: GYAE6OF02GZL4T.21.62.F07.1.454.CMB.1.raw
  modified_base (215)..(260): a, c, t, g, unknown or other
  misc_feature (215)..(260): n is a, c, g, or t
tcagtcgtcgctcgcacgaccggtgctcgatttagtagtcgcataaagggaaggggtaaggactgacggtcctcccgaggagttcaggtgctgggcaccgtgggcatggggaggtgtgttcacaagatttgggctctgggcacagcggccctgggctgcctggtcaaggactacttccctgtcctctactgagcgggctcggcaaggcgcatagnnnnnnnnnnnnnnnnnnnnnnnnnnnnnnnnnnnnnnnnnnnnnn

SEQ ID NO: 19120 - DNA, 215 bp, Homo sapiens
  misc_feature: GYAE6OF02HENIE.21.62.F07.1.454.CMB.1.raw
  modified_base (211)..(215): a, c, t, g, unknown or other
  misc_feature (211)..(215): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnnn

SEQ ID NO: 19121 - DNA, 211 bp, Homo sapiens; identical to SEQ ID NO: 19096
  misc_feature: GYAE6OF02HO7RN.21.62.F07.1.454.CMB.1.raw
  modified_base (209)..(211): a, c, t, g, unknown or other
  misc_feature (209)..(211): n is a, c, g, or t

SEQ ID NO: 19122 - DNA, 223 bp, Homo sapiens
  misc_feature: GYAE6OF02HB96N.21.62.F07.1.454.CMB.1.raw
  modified_base (211)..(223): a, c, t, g, unknown or other
  misc_feature (211)..(223): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnnnnnnnnnnn

SEQ ID NO: 19123 - DNA, 212 bp, Homo sapiens
  misc_feature: GYAE6OF02HO4ZE.21.62.F07.1.454.CMB.1.raw
  modified_base (211)..(212): a, c, t, g, unknown or other
  misc_feature (211)..(212): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnn

SEQ ID NO: 19124 - DNA, 215 bp, Homo sapiens; identical to SEQ ID NO: 19120
  misc_feature: GYAE6OF02INPFV.21.62.F07.1.454.CMB.1.raw
  modified_base (211)..(215): a, c, t, g, unknown or other
  misc_feature (211)..(215): n is a, c, g, or t

SEQ ID NO: 19125 - DNA, 214 bp, Homo sapiens
  misc_feature: GYAE6OF02JJ4V6.21.62.F07.1.454.CMB.1.raw
  modified_base (209)..(214): a, c, t, g, unknown or other
  misc_feature (209)..(214): n is a, c, g, or t
tcagtcgtcgctcgcacgaccggtgctcgatttagtagtcgcataaaggaagggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnnnn

SEQ ID NO: 19126 - DNA, 214 bp, Homo sapiens
  misc_feature: GYAE6OF02H4AQA.21.62.F07.1.454.CMB.1.raw
  modified_base (210)..(214): a, c, t, g, unknown or other
  misc_feature (210)..(214): n is a, c, g, or t
tcagtcgtcgctcgcacgaccggtgctcgatttagtagtcgcataaagggaagggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnnn

SEQ ID NO: 19127 - DNA, 259 bp, Homo sapiens
  misc_feature: GYAE6OF02GME1G.21.62.F07.1.454.CMB.1.raw
  modified_base (218)..(259): a, c, t, g, unknown or other
  misc_feature (218)..(259): n is a, c, g, or t
tcagtcgtcgctcgcacgaccggtgctcgatttagtagtcgcataaagggaaggggaaggactgacggtcctcccgaggagttcaggtgctgggcaccgtgggcatgggggacgtgtgtcacaacgatttgggctctgggcacagcgggccctggggcctgcctggtcaaggctacttccctgtcctctacgagcgggctgggccaaggcgcgatagnnnnnnnnnnnnnnnnnnnnnnnnnnnnnnnnnnnnnnnnnn

SEQ ID NO: 19128 - DNA, 243 bp, Homo sapiens
  misc_feature: GYAE6OF02JJP27.21.62.F07.1.454.CMB.1.raw
  modified_base (214)..(243): a, c, t, g, unknown or other
  misc_feature (214)..(243): n is a, c, g, or t
tcagtcgtcgctcgcacgaccggtgctcgatttagtagtcgcataaaggggaaggggaagactgacggtcctcccaggagttcaggtgctgggcaccgtgggcatgggggaggtgtgtcacaagattttgggctctgggcacaggcggccctgggctgcctggtcaaggctacttccctcgtctctactgagccgggctggcaaggcgcatagnnnnnnnnnnnnnnnnnnnnnnnnnnnnnn

SEQ ID NO: 19129 - DNA, 219 bp, Homo sapiens
  misc_feature: GYAE6OF02FJ0UH.21.62.F07.1.454.CMB.1.raw
  modified_base (211)..(219): a, c, t, g, unknown or other
  misc_feature (211)..(219): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcgcatagnnnnnnnnn

SEQ ID NO: 19130 - DNA, 223 bp, Homo sapiens
  misc_feature: GYAE6OF02GJH5P.21.62.F07.1.454.CMB.1.raw
  modified_base (205)..(205): a, c, t, g, unknown or other
  misc_feature (205)..(205): n is a, c, g, or t
  modified_base (211)..(223): a, c, t, g, unknown or other
  misc_feature (211)..(223): n is a, c, g, or t
tcagtcgtcgctcgcacgaccggtgctcgatttagtagtcgcataaagggaaggggaagactgacggtcctcccaggagttcaggtgctgggcaccgtgggcatgggggaggtgtgtcacaagatttgggctctgggcacagcggccctgggctgcctggtcaaggactacttccctcgtctctactgagcgggctggcaaggcncatagnnnnnnnnnnnnn

SEQ ID NO: 19131 - DNA, 219 bp, Homo sapiens; identical to SEQ ID NO: 19129
  misc_feature: GYAE6OF02IOA4V.21.62.F07.1.454.CMB.1.raw
  modified_base (211)..(219): a, c, t, g, unknown or other
  misc_feature (211)..(219): n is a, c, g, or t

SEQ ID NO: 19132 - DNA, 852 bp, Homo sapiens
  misc_feature: GYAE6OF02ILEU8.21.62.F07.1.454.CMB.1.raw
tcagtcgtcgctcgcacgaccggtgctcgatttagtagtcgcataaagggaaggggaagacctgacggtcctgctgctgaccatcccgttcatgggtcttgtcccagatcaccttgaaggagtctggtcccacgctggtgaaacccacagagaccctcacgctgacctgcacttctctggttttcactcagtaccatgcagtgggtgtggctggactccgtacaccggtacccccggaaaggccccggagtcggcttagccactctatttagtaggatgatcgaactaaccactacgacgtcctaatctctaggacgtccgaggtcctaccgacccgtacgaaccgtaacgacccaaccgtaacccaaaaaccgtggttaccggtaccctaaacgtaccgtaacggaaccctaaaccgtaacgtaccggaaccccagttacggaaccaacgacaccgaactactacttaacgtcgtacgaccgaacggtaacgggtacgttacggtacggttacgggtacgggttaccggggtaaccggttaaccggggttacgggggacccggtaaacgggggttaccgttacccgggttaaccgggttaccgttaaaccccggtcccgttaaccggtccggtaaccggtaccccggttaccccggaaaacccgggtaacccgggtaccccgtaccggggtttacccggttcccccgtttcccccgggtacgggttcccccggtaccccgttccggtaccccggtacccgggtacggtaccccgtaccccgttacccggttacccgggaccggtacccggaccccggtaacccgggtcccggtaccccggttcccccgggg

SEQ ID NO: 19133 - DNA, 504 bp, Homo sapiens
  misc_feature: GYAE6OF01C0960.35.10.A10.1.454.CMB.1.raw
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggtggcctggtatcagcagaaaccagggaaagcccctaaatcctgatctttaaggcgtctactttagagagtgggtcccatcaaggttcagcggcagtggatcgtggggacagacttcactctcacatcaccagcctgcagcctgatgtattttgactaacctattactgaccaactagtatggtgtattccgtctacgtttcgccctgggaccaagtgatactacaaacgactgtggntgcacctatctcgtcttnactccttcccgc

SEQ ID NO: 19134 - DNA, 582 bp, Homo sapiens
  misc_feature: GYAE6OF01CLSSA.35.10.A10.1.454.CMB.1.raw
tcagtacagatcgtcacgaccggtgctcgatttagcgtcgatctcagggggagtcagacccagtcaggacacagcatggacatggacgggtccccgctcagctccgtggggctcctgctgctctggctcccaggtgaccaaatgtgacatccagctgacccagtcctccctccaccctgtctgcatctgtaggagacagcgtcaccatcacttgccgggacaagtcagagctagttggctagttacttttaaagttggtatacgaaacggaaaccaagggaaacacccctaaactcctagatctatgctgcatcctattttgactaaaggtcggggtacccgacgtaaggttcgaggtggactaggtggattcgtaggggaacaggtaacttcgactcgtacacatcagcagtctgctaacctgaagtatttcgacctaacttactattacgtacaactagtacgttacgacgtaccgcccgacgtactacgacgtccgttacggaccgaaggaccacgtacgtaggaacgtaagttaaaacggtacgtaggtagtacgtacgacacctacttcgtgttacc

SEQ ID NO: 19135 - DNA, 585 bp, Homo sapiens
  misc_feature: GYAE6OF01DXF56.35.10.A10.1.454.CMB.1.raw
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaaagcgtcaccatcacttgccggacagtcagagtattagtaattggttgcctggtatcagcaagaaaccgaggggaaacncccctaaaactcctagaattctttaaaggccgttactactttagagagtcgggtaccatcgaaggttcagcggnagtgatcgtgggacagacttcactctacacatccacagcctgcacgctgattgtatttcgactaaaccttattacacgtaccaaacgtagtagttacggtgtaactttcccgtactacccgttttccgggacccctttaggggaaccctaaaggtcgtaacttaagtaaccgaaaacgtaacgtggtcggacttacgaccaccgtatcgttacgttccttacacttcccgtccccgtacc

SEQ ID NO: 19136 - DNA, 532 bp, Homo sapiens
  misc_feature: GYAE6OF01ET327.35.10.A10.1.454.CMB.1.raw
  modified_base (431)..(431): a, c, t, g, unknown or other
  misc_feature (431)..(431): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcaagaaaccagggaaacgacccctaaactcctgatctttaaggcgtctacttagagagtggggtccatcaaggttcagcggcagtggatcgtgggacagtacttcactctcaccatcaccagcctgcacgcctgattgtattttgactaaccttattactgacccaactagtagtggtntacgttccgtactaccgtttccgggcccttagggaacctaaaggtgaatactacaaacgtactggtcggctgccaccatctgtcttacacttcctcccgtc

SEQ ID NO: 19137 - DNA, 539 bp, Homo sapiens
  misc_feature: GYAE6OF01CNFFI.35.10.A10.1.454.CMB.1.raw
  modified_base (522)..(522): a, c, t, g, unknown or other
  misc_feature (522)..(522): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctagatctttaaggcgtctactttagagagtgggtccatcaaggttcagcggcagtggatctgggacagacttcactctcaccatcacagcctgcagcctgatgtattttcgactaaccttattactgaccaacagtatggtgattccgtactacgtttccgggcccttagggaccctaaaggtcggtaatacgtacaaaaccgtactaggtcggtactcggccacctattcctcgttccttnacttccttcccgtaccc

SEQ ID NO: 19138 - DNA, 505 bp, Homo sapiens
  misc_feature: GYAE6OF01EZ4LJ.35.10.A10.1.454.CMB.1.raw
  modified_base (494)..(494): a, c, t, g, unknown or other
  misc_feature (494)..(494): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtggggtcccatcaaggttcagcggcagtggatctgggacagacttcactctcaccatcaccagcctgcagcctgatgattttgctaacctattactgccaacagtatggtgtattccgtactaccgtttcggcccgtcgggaccaaggtgatatacaaacgactgtggctgcacctatctgtcttnctctcccgtcc

SEQ ID NO: 19139 - DNA, 495 bp, Homo sapiens
  misc_feature: GYAE6OF01AXBNI.35.10.A10.1.454.CMB.1.raw
  modified_base (490)..(490): a, c, t, g, unknown or other
  misc_feature (490)..(490): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtgggtccatcaaggttcagcggcagtggatctgggacagacttcactctcaccatcaccagcctgcagcctgattgtatttgctagtttattactgtcagcaatataatgctgcctcgtagttcgctcgtttggcctaggggaccaaggtctggagtatacgaaacgacgtgtgctagcacntctcg

SEQ ID NO: 19140 - DNA, 505 bp, Homo sapiens
  misc_feature: GYAE6OF01DQT90.35.10.A10.1.454.CMB.1.raw
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcacatcacttgccggaccagtcagagtattagtaattggttggcctggtatcagcagaaaccagggaaagcccctaaactcctgatctttaaaggcgtctactttagagagtgggtcccatcaaggttcagcggcagtggatctgggacagacttcactctcaccatcaccagcctgcagcctgatgtattttgactaacctattactgaccaacagtatggtgactttccgtctactttcggcccttgggaccaaaggtggaatactacaaacgatgtggntgcacatctgtcttnactcttccgac

SEQ ID NO: 19141 - DNA, 615 bp, Homo sapiens
  misc_feature: GYAE6OF01EBABB.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctctaccctgtctgcatctgtaggagaaagcgtcaccatcacttgccggaccagtcagagtattagtaattggttggcctggtatcagcagaaaccagggaaacgcccctaaactcctgatctttaaggcgtctactttagagagtgggtccatcaaggttcagcggcagtggatctgggacagacttcactctcaccatccaccagcctgcacgcctgacttgtacttttcgacctaaccttattactcgaccaactagtatggtgtactttccgtacttaccgttttccgggaccccttaggggaaccctaaaggttcgggtaacttaacgtaaccgtaaaaaccggtaaaccgtttgggttacggggtaccttacgggccctaaaccccgtaagtttcccgtttacggtttaccctttacctaactttccccgttccccccggtaccc

SEQ ID NO: 19142 - DNA, 503 bp, Homo sapiens
  misc_feature: GYAE6OF01A62YW.35.10.A10.1.454.CMB.1.raw
  modified_base (490)..(490): a, c, t, g, unknown or other
  misc_feature (490)..(490): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtgggtcccatcaaggttcagcggcagtggatctgggacagacttcactctcaccatcaccagccctgcagcctgatgattttgctaacctattactgccaacagtatggtgtattccgtcactttcggcccgtgggtaccaagtggatatacaaacgaactgtggctgcaccatctgtcttnacttctcccgtcc

SEQ ID NO: 19143 - DNA, 561 bp, Homo sapiens
  misc_feature: GYAE6OF01DPFIV.35.10.A10.1.454.CMB.1.raw
  modified_base (266)..(266): a, c, t, g, unknown or other
  misc_feature (266)..(266): n is a, c, g, or t
  modified_base (354)..(354): a, c, t, g, unknown or other
  misc_feature (354)..(354): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggtgcctggtatcagcagaaaccagggaaancccctaaatcctgatctttaaggcgtctactttagagagtgggtccatcaaggtcagcggcagtggatcgtgggacagacttcactcncaccatcaccagcctgcagcctgatgtattttgactaaccttattactcgaccaactagtagtggtgtacttaccgttctaaccgttttccgggtcccgttacggggaacctaaaggtcggtaacttaacgtaccgaaaaccgtaacgtcggtacggacttcggaccaacctattcttcgttacttctaacttcccttccccgtacc

SEQ ID NO: 19144 - DNA, 590 bp, Homo sapiens
  misc_feature: GYAE6OF01BTLSQ.35.10.A10.1.454.CMB.1.raw
  modified_base (267)..(267): a, c, t, g, unknown or other
  misc_feature (267)..(267): n is a, c, g, or t
  modified_base (372)..(372): a, c, t, g, unknown or other
  misc_feature (372)..(372): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcagaaaccagggaaancccctaaatcctgatctttaaggcgttactactttagagaggtgggtcccatcgaaggttcagcggcagtggatcgtgggacagattcactctcaccatcagtancctgcagcctagattgtactttgacctaactatttactgacctaaactattaacagtaccttaactttacttttccttccgttttcgggaccgggtaacgggtaacctaagggttggaacctagttccgaaaggtaccgtaaacgttggtacggcttacggaccctaacccgatttccgttacggttacctttaccaacgtttcccgttaacccccgg

SEQ ID NO: 19145 - DNA, 491 bp, Homo sapiens
  misc_feature: GYAE6OF01D4OSI.35.10.A10.1.454.CMB.1.raw
  modified_base (486)..(486): a, c, t, g, unknown or other
  misc_feature (486)..(486): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaaactcctgatctatgctgcatccattttgcaaagtggggtcccggcaaggttcagtggcagtggatctgggacagaattcactctcaccatcagcagtctgcaacctgaagtattttgacaacatactattgtcaacagagttacagtacgcccgcgatcagcttcggccaagggacacgactggagattaaagactgtaggctagacacntctcg

SEQ ID NO: 19146 - DNA, 506 bp, Homo sapiens
  misc_feature: GYAE6OF01AUTEV.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaacgcccctaaactcctgatctttaaggcgtctactttagagagtgggtcccatcaaggttcagcgcagtggatcgtgggacagacttcactctcaccatcagcagtctgcaacctgaatatttgctaacttactactgtacaacagattacagtcgcttcacgtttcggcgggaggaccaaggtgacagtacaaacgactggcggctgacacctatcttgtcttcatccttcccgctacg

SEQ ID NO: 19147 - DNA, 551 bp, Homo sapiens
  misc_feature: GYAE6OF01EXWZC.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgttctactttagagtagtcggggtcccatcaaggttcagcggcagtggatcgtgggacagacttcactctcaccatcaccagcctgcagcctgatgtattttcgactaaccttattactgtaccaactagttatggtgtactttccgtactaccgtttccgggcccgttagggaacctaaaggtggaatatacgaaaccgtaactggtcggactgccaacctatccgttcgttacttacctacttcccttcccgtacc

SEQ ID NO: 19148 - DNA, 510 bp, Homo sapiens
  misc_feature: GYAE6OF01BWZ9O.35.10.A10.1.454.CMB.1.raw
  modified_base (269)..(269): a, c, t, g, unknown or other
  misc_feature (269)..(269): n is a, c, g, or t
  modified_base (481)..(481): a, c, t, g, unknown or other
  misc_feature (481)..(481): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccaggggaaanccccctaaactcctgatctttaaggcgtctactttagagagtgggtcccatcaaggttcagcggcagtggatcgtgggacagacttcactctcaccatccaccagcctgcacgcctgatgtattttgactaacctattactgacccaacagtatggtgtattccgtctacgtttcggcccgtggaccaagtggatagtacaaacgactgtgntgccactatctgtcttcatcctcccgtcc

SEQ ID NO: 19149 - DNA, 660 bp, Homo sapiens
  misc_feature: GYAE6OF01EEQRQ.35.10.A10.1.454.CMB.1.raw
  modified_base (522)..(522): a, c, t, g, unknown or other
  misc_feature (522)..(522): n is a, c, g, or t
tcagtacagatcgtcacgaccggtgctcgatttagcgtcgatctctagggggtagggtcagacccagtcaggacacagcatggacatgagggtccccgctcagctcctggggctcctgctgctctggctcccaggtgccaaatgtgacatccaggctcgaccagtcctccctccacctgtctgctatctggtaggagaagtcgtacacatctacgtggccgacaggtcagtaggtagttagtttaagtcggttggtcctggtatcaagaccaaggaaaaccaccgggaaaactcccctaaacctccctagtacgtacgtttaacggcgttaccttaactttacgacgtaggtcgggtacccctatacgtaaggttcaggcggacgtaggtgatcggtagggacaagtactactactctaccaacctactacaccgtacgccgttagacctagtacctgtaacttggtaactttacgactaaacccttattaccacgacctaaacgtagtttaactttcggtntacgttccgttaccttacggtttccgaccggtcggaaccggtaaggtgggaatacgtacgtaaaccgtaacttgggtcgggtactcggcctaacccaattccgtaggttccctttatacttcccgttccccgtaaccc

SEQ ID NO: 19150 - DNA, 745 bp, Homo sapiens
  misc_feature: GYAE6OF01AIHA4.35.10.A10.1.454.CMB.1.raw
tcagtacagatcgtcacgaccggtgctcgatttagcgtcgatctcaggggagtcagacccagtcaggacacagcatggacatgagggtccccgctcagctcctggggctcctgctgctctggctcccaggtgccaaatgtgacatccagcctgacccagtcctccctccaccctgtctgcatctgtagagaagcgtcaccatcacttgccgacagtcagtactattagtaattggttggcctgggtaactcgagtaccgaaggtaaacccgaaggggaaaccgtaccccctaaacgtcccgtagtaacttaccgttttaaacgggccttacttaaccgttttaaggagggtaacgggtttcgggggtaccccctaagttaccgtaaacgggtttccaacgggtccgggaccgttagggtaccgggatttacggtcgggggaactacgggtacccttacctaccgttaccgtccaaacccgttattacccgaccctaccgcccgttacggaccctacggtacccgtacgtacgttagttacgtttttacggaaccttaacccgtttactttaacctacggtaccctaacgtacgttaacgttggttacgttacttcccggttacttacccggtttcggtcccgttacgggtaaccgtaacggtaggtactaagtactaaacgtaacgttgtacggtccgtacgactaccctagttctacgttcttactccttccgttcccgtaccc

SEQ ID NO: 19151 - DNA, 832 bp, Homo sapiens
  misc_feature: GYAE6OF01D3YYC.35.10.A10.1.454.CMB.1.raw
tcagtacagatcgtcacgaccggtgctcgatttagcgtcgatctcgagggggagtcagacccagtcaggacacagcatggacatgagggtcccgctcagctcctggggctcctgctgctctggctccaggtgccaaatgtgacatccagctgacccagtctccctccaccctgtctgcatctgtaggagaaagctcaccatcacttgccggacagtcagatattagtaattggttgctggtatcagcaagaaaccagggaaacgtacccctaaaactcctagtaacttcgtttaaggcgttactaacgtttaggaggtaggtcggggtaccctagttacgtaaggtttcaacgggtccgggactagggttacggaacgttcggtacgggggaactaacggtacccttttaccgaacccgttccttacccaaacccgtacttacccgaaaccccgtaacggtccccgtttacggacccgtaaaccgggtccccgtttagggtaaccgttttacgggttaaacgtttttttaccgggaaccctttaaaaccccgtttaagttttaaaccgttaccgggtaaacccctaaacggttaacggtttaacggtttacgggttacgttaaccgttttcccggttaaccgttaccggtttttaccccggggtacccgttaacgggggtaaacccgttaaaaggggttcggtaaacgttaacgtaacccgtaaaaaccggttaaaccggttcgggttacggtcgttaaccggtaccaaaccccgtgtttcccgttcggttaccctttaccgttacctttaccccggttccccggttaaccc

SEQ ID NO: 19152 - DNA, 598 bp, Homo sapiens
  misc_feature: GYAE6OF01CMZ86.35.10.A10.1.454.CMB.1.raw
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtgggagacagcgtcatcatcacttgcctggccagtcagacgattagtgactggttgctggtatcagcagaaccaggacaaaaaccctaactcctagtaatttanaaggcctacttaagtttaacaaaggtcggggtacccaggcgtaagggttcggcggacaggtggatcgtagggacagtatttcactctacacatcagcaactgcagtcctaggacgtactttgactaacttatacngacccaaatagttaataacttacgtttaccctacgttaaccgtttcggggacgggtaaacgggacctaaagggtacgaacgaaaccgtaaaacggaacgttggtacgggccttaggacccaaccctagttccttacgttaccctttacgaacctttcccgttccccgtctaacg

SEQ ID NO: 19153 - DNA, 622 bp, Homo sapiens
  misc_feature: GYAE6OF01C73H5.35.10.A10.1.454.CMB.1.raw
  modified_base (403)..(403): a, c, t, g, unknown or other
  misc_feature (403)..(403): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccgaccagtcagagtattagtaagttggttgcctggtatcagcaagaaaccgagggaaacgacccctaaactcctagtattacgtttaaggccgttacttacgtttaggaggtaggtcgggtaccctagtacgaaggttcaggcggcaggtgagtcgtgggactagtacttcgctactcaccactcaccgtacnccgtgacacgcctgtactgtactttgacctaacttactactcgtaccaactagttacgtggtacgtacgtttccgtactacccggtttccgggacccgttagggaaccgttaaacgggtgtaacttaccgtaacgaaaccggttacgtcggtacgggtacctcggccctaccgttacgttcgtttacgttctttacctcccgttcccgtccccgtaacc

SEQ ID NO: 19154 - DNA, 511 bp, Homo sapiens
  misc_feature: GYAE6OF01BPH9T.35.10.A10.1.454.CMB.1.raw
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcagaaaccagggaaagcccctaaactcctgatctttaaggcgtctactttagagagtgggtcccatcaaggttcagcggcagtggatctgggacagacttcactctcaccatcaccagcctgcagcctgatgtattttgactaacctattactgccaactagtatggtntacttccgtctacgtttccggcccttgggtaacccaagtcgattatacaaacgtactgtcgntgcaccatctgtcttacattcctccgtac

SEQ ID NO: 19155 - DNA, 639 bp, Homo sapiens
  misc_feature: GYAE6OF01EGRXO.35.10.A10.1.454.CMB.1.raw
  modified_base (263)..(263): a, c, t, g, unknown or other
  misc_feature (263)..(263): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaaagcgtcaccatcacttgccgacagtcagagtattagtattggtgctggtatcagcagaaaccaggaaacncccctaaactcctagtacttacgtttaaggcgttacttacgtttaggagtaggtcggggtacccagtacgtaaggttcaggcggacaggtggatcgtagggacagtacttcactctacacctataccaccgagcctagcacgtcctagtattgtatttcgacctaaccgttattaccgtacgacctaacgtagttagttcggtagttaacgttcccgttacttaccgtttcccgggacccgttaagggaacccgtaaagggttacggaattaacgtaaaccgaaaccggttaacgttcgggtacggtaccgtacggtaccacccgttacgttacgttccgttacctttacctcgtttccccgttccccggtaaccc

SEQ ID NO: 19156 - DNA, 512 bp, Homo sapiens
  misc_feature: GYAE6OF01A4H6F.35.10.A10.1.454.CMB.1.raw
  modified_base (266)..(266): a, c, t, g, unknown or other
  misc_feature (266)..(266): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctcaccctgtctgcatctgtaggagaaagcgtcaccatcacttgccggaccagtcagagtattagaattggttggcctggtatcagcagaaaccagggaaancccctaaactcctgatctttaaggcgtctactttagagagtggggtcccatcaaggttcagcggcagtggatctgggacagacttcactctcaccatcaccagcctgcacgcctgatgtatttgactaacctattactgaccaacagtatggtgtattccgtctacgtttcggccctagggtaccaaggtaggatatacgaaacgtaactgtgcgtgcacctatctgtctcacttcttcccgtacc

SEQ ID NO: 19157 - DNA, 567 bp, Homo sapiens
  misc_feature: GYAE6OF01B943K.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaaagcgtcaccatcacttgccggaccagtcagatattagtattggtggctggtatcagcaagaaaccagggaaacgccccctaaatcctagattctttaaggctctactttagagagtgggccatcaaggttcagcgcagtggatcgtgggacagacttcactctcacctatccaccagcctgcacgtcctagacttgtattttcgactaaccttattacctagacccaatagtataggtgtacttccgtctaccgtttccggacccgtagggaacctaaaggtggtaaactacgtaaccaaacggtaacgttggtcggattaccggctaccctagttccttacgttaccttacctacttcccgttacccgtaccg

SEQ ID NO: 19158 - DNA, 580 bp, Homo sapiens
  misc_feature: GYAE6OF01EMOBC.35.10.A10.1.454.CMB.1.raw
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (545)..(545): a, c, t, g, unknown or other
  misc_feature (545)..(545): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctcccctccaccctgtctgcatctgtaggagaagcgtcaccatcacttgccggaccagtcagagtattagtaattggttgcctggtatcagcaagaaaccgagggaaccaccctaaactctagtacttcgttaaggcgttacttacgtttagaggtaggtcgggtacctatacgtaaggttcagcggcaggtggatcgtagggacagtacttcactcnccacatccaccagcctgccagtcctntagttntatttcgactaaccttataccactaccaagtagtacgttggtactactttccgtccttacgtttccggaccgtacgggaacctaaggttcggaattacgtaaccgaaacgtacgtagtcggactacgccaccttntcgttcgttaccttacttaccttcccgtccctacg

SEQ ID NO: 19159 - DNA, 569 bp, Homo sapiens
  misc_feature: GYAE6OF01CEPMS.35.10.A10.1.454.CMB.1.raw
  modified_base (245)..(245): a, c, t, g, unknown or other
  misc_feature (245)..(245): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggacagtcagagtattagtattggtgctggtatnagcagaaaccaggaaacgcccctaaactcctgatacgtttaaggcgttctactttagagtaggtcgggtcccagtcaaggttcagcggcaggtggatcgtgggacagtacttcacttctaccaacctatccaaccacgccctgccacgtccgtgattgtattttcgacctaaccttattactcgaccctaaactagtagttggtagtactttacccgtctaccgtttccgggtacccgtagggtaaccaaggtgaactactacgaaacgacttaggcggtatacgaccacagttcctgttcttactacttcccgttcccgtacc

SEQ ID NO: 19160 - DNA, 533 bp, Homo sapiens
  misc_feature: GYAE6OF01B1O1I.35.10.A10.1.454.CMB.1.raw
  modified_base (267)..(267): a, c, t, g, unknown or other
  misc_feature (267)..(267): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcagaaaccagggaaancccctaaactcctgatctttaaggctctactttagagagtggggtcccatcaaggttcagcggcagtggatctgggacagacttcactctcacatcaccagcctgcagcctgatgtatttgacctaacttattactgaccaactagtattggtgtactttcccgtctaccgttttccgggcccttagggaaccctaaaggtggtaatacgtacaaacgtaacttggtcggtctgcaccattctcgtcttacattccgttcccgacc

SEQ ID NO: 19161 - DNA, 893 bp, Homo sapiens
  misc_feature: GYAE6OF01A8W7L.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggaccaaaaaccctaactcctagtatttagtaacggccttacgttaagtttaaccgaaagggttcgggggtaccccaaggtaccgtaaaggggtttccggggaccgggtaccgtaagggttcggggtaacgttccggttaacgggggaacctaacgggttaaacgttttttacccgaaacccgtttaccccgttaccctaaaccccgtaaacgttacccgaaacgggtaacccctaaaaccccggttcggacccgtaaacgggtccccgtttaggggtaaacgggttaacctttttacgggaaaccctttaaaacccgtttttaacgttttaacccggttaccggtaacccgtaaaaccgtaacggtttaaacgtttaaaccgtttaacccggtttttaaacccccgttaacgttttaaaacccggtttttaccgggggaaccggggtaaaccggggtaaaccccgtaaaggggttaaccggaaaccggtaaacccggtaaaaaccggtaaccgttacgggtaccgggtaaccgttacggaacccttaacccgtaacgtttcccgttacggtttaccctttacccgtaaccgtttaccccgtttaccccccggtacttaccggttaacccg

SEQ ID NO: 19162 - DNA, 627 bp, Homo sapiens
  misc_feature: GYAE6OF01ADXNB.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggacagtcagagtatagtaattggttggcctggtatcagcaagaaaccagggaaacgcccctaaactcctgatcgtttaaggcgtcttactttagagagttgggtcccatcaaggttcaggcggcaggtggatcgtgggactagacttcactctcaccatccaccacgcctgcacggcctgacttgtacttttgacctaaccttacttaccgtagcccgtaaacaggtttacgtgggttactaccgtttcccgtactaccggttttccgggtacccgttagggaacccttaaaggtacgggtaacttacgtaaccgaaaaaccggttacgtcgggttacggtcgttaccggccctaacccgtatttccgttacggttaccttaccttaccctttaccccgttccccccgttaaacg

SEQ ID NO: 19163 - DNA, 540 bp, Homo sapiens
  misc_feature: GYAE6OF01A0FJU.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctcaccctgtctgcatctgtaggagaaagcgtcaccatcacttgccggaccagtcagagtattagtaattggttggcctggtatcagcagaaaccagggaaacgcccctaaactcctgatctttaaggcgtctactttagagagtgggtcccatcaaggttcagcggcagtggatcgtgggacagacttcactctcaccatccaccagcctgcacgcctgatgtattttgacctaacctactattgtacaacagtagttacacgttacgcccgacgactcgagtccgttcggaccgaagggaccacgtacgtaggaagtaaagttaaaaggaacttggtcggacctggacctacctacttcttgttccttctaccg

SEQ ID NO: 19164 - DNA, 610 bp, Homo sapiens
  misc_feature: GYAE6OF01BPR9R.35.10.A10.1.454.CMB.1.raw
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccggacagtcagtagtattagtattggtgctgtatnagcagaaccaggaacacccctaaactcctgatacgttaaggcgtactacttagaggtaggtcgggtccatacgaaggttcaggcgganaggtgagtcgtagggacagtacttcactctccaccatccaccgacgcctgcacgtcctagtatgtatttcgactaaccgttattacgtacgacctaatagtacgtggtacgttacgttcccgtactaccgtttccgggaccccgttaacgggtaaccctaaaggtcggtaaagtactaacccgtaaacgtaacggttcggtacgggtaccgtacgtaccccgtaaccttcgttaccgttaggtttaccccttactcccgttccctccccgtaacccg

SEQ ID NO: 19165 - DNA, 596 bp, Homo sapiens
  misc_feature: GYAE6OF01DF3OR.35.10.A10.1.454.CMB.1.raw
  modified_base (262)..(262): a, c, t, g, unknown or other
  misc_feature (262)..(262): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctcccctccaccctgtctgcatctgtaggagaagcgtcaccatcacttgccgacagtcagagtatagtattggtgctgtatcagcaagaaaccaggaaacncccctaaactctgattcgtttaaggcgttacttacgtttagagtaggtcgggtacccagtacgaaggttcaggcggacaggtggatcgtagggacagtacttcactctcacataccaccagtcctgcagcctgattgtatttacgactaacctattactgacccaatagttatggttgtactttccgtactaccgtttccgggacccgtagggtaaccctaaaggtggtaaacttaactacgaaaaccggtacgttcgggtacggtacgttacggaccctaacccgtattcccgttacgtttacccttacgtaccttcccgttccccggtaacc

SEQ ID NO: 19166 - DNA, 635 bp, Homo sapiens
  misc_feature: GYAE6OF01CM80M.35.10.A10.1.454.CMB.1.raw
  modified_base (363)..(363): a, c, t, g, unknown or other
  misc_feature (363)..(363): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtagagaagcgtcaccatcacttgccggaccagtcagagtatagtattggtgcctggtatcagcagaaaccaggaaacgcccctaaaatcctgatcgtttaaggcgttctactttagagtaggtgggtcccagtcgaaggttcaggcggcaggtggatcgtagggacagacttcactcncacatcaccagcctgcagcctgatgtatttgacctaacttattactcgaccaatagtagttggtacgtaacgtttcccgtacttaccggttttcccgggtacccggttacggggtaaccctaaagggttcgggtaaacttacgttaacccgtaaaaaccggtaaccgttacggttacggggtacccgttacggtcccgaacccttaacgtttcccgttacggttttacccgtttaccttaacccgtttccccgttttacccccggtaacccc

SEQ ID NO: 19167 - DNA, 595 bp, Homo sapiens
  misc_feature: GYAE6OF01EM13O.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcaagaaaccagggaaacgcccctaaactcctagtatctttaaggcgtcttactttagagagtcgggtccatcaaggttcagcggcagtggatcgtgggacagacttcactctcaccatcacacgctgcacgctgatgtatttcgactaacctattactacgaccaactagttagtgggtacgtacgtttcccgttacttacccggttttccgggaccccgttaggggtaaccctaaagggttcggaattaacgtaacctaaaacggtacgttaggtacggtctacggacctacccttataccgttcggttaccttaccgtactttccccgttccccggtaacc

SEQ ID NO: 19168 - DNA, 714 bp, Homo sapiens
  misc_feature: GYAE6OF01C1ODN.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctagtaggagaagctcaccatcacttcgccggacagtcagtatatagtaattggtgcctggtatcgagacaagaaaccgaaggggaaacaccctaaactcctagtacttacgtttaacggcttactaacgtttacgaggtaggttcgggtaccctagttacgtaaggttccagggccggtacgtaggttacggagtacggtaggggaactaggtacctttcgaaccttccgttaccaccattacccaccgaacgtccctacggacctacggcccttaggtagttacggttacttttaccgaaccttaaaccgttacttaccgtacgacccctaaagtacgttaagttcgggtacttaccgtttaccgttaccgttaccggtttacccgggtacccggttaagggaaacccgttaagggttacggtaaacttacgtaacccgaaaacggtacgttacgggtacgggtcaacggtcccaaaccttgtcccgtttacggttcccttaaccgttccttccccgttcccgtaacccg

SEQ ID NO: 19169 - DNA, 503 bp, Homo sapiens
  misc_feature: GYAE6OF01A4TYB.35.10.A10.1.454.CMB.1.raw
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtggggtcccatcaaggttcagcggcagtggatcgtgggacagacttcactctcaccatcaccagcctgccagcctgatgtattttgcaacctattactgaccaacagtatggtgattccgtcactttcggcctgggacaagtgatancaaacgactgtcgntgccacattctcgtcttacacttcctcccgtacc

SEQ ID NO: 19170 - DNA, 574 bp, Homo sapiens
  misc_feature: GYAE6OF01B9V15.35.10.A10.1.454.CMB.1.raw
  modified_base (190)..(190): a, c, t, g, unknown or other
  misc_feature (190)..(190): n is a, c, g, or t
  modified_base (293)..(293): a, c, t, g, unknown or other
  misc_feature (293)..(293): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtagganaagcgtcaccatcacttgccggaccagtcagagtattagtaattggtgcctggtatcagcagaaaccagggaacacccctaaactctagattcttaaggcgtntactttaggagtagtcgggtccagtacgaaggttcaggcggcaggtggatcgtgggacagacttcactctcacatcaccagcctgcagtcctgattgtacttttgacctaacctattactcgacctaacgtagtagttcggtacgtaactttccgtacgtaccgtttccgggacccgttacgggaacctaaggtcggtaattacgtaacgtaaacgtacgttaggtacggtactacggccaacctagttcttacgttcttactacttccgttccccgtacc

SEQ ID NO: 19171 - DNA, 837 bp, Homo sapiens
  misc_feature: GYAE6OF01BQEFO.35.10.A10.1.454.CMB.1.raw
  modified_base (95)..(95): a, c, t, g, unknown or other
  misc_feature (95)..(95): n is a, c, g, or t
  modified_base (106)..(106): a, c, t, g, unknown or other
  misc_feature (106)..(106): n is a, c, g, or t
tcagtacagatcgtcacgaccggtgctcgatttagcgtcgatctcagggggagtcagacccagtcaggacacagcatggacatgagggtccccgntcagcctcggnggcctcgtgctcgtctcgtcggtccctaccggtaggtccgaactaagttggtacaacctactaccgaagtacgtacccgaacccgtacttcccctaccccctacccgtacccgttcgtcgtacgactacgttcgttaggaggaacgacgaggtactacctaatttaacgtttcggttcgggaccgacgtaggtaggaagtaagttaagttaaggttgggttcggtccgtcgttagtactacgacgtaacgaaaccggaaacggaacggaaccctaccgtaagtccttacgagtagtaggtacggtcggtcttcgttacgtaactaaagtaacgggtcccggtaaccctaacggttacgtacgacggcgtagtaggtgtacgtcgggaagtataacgttactacacttaccgaacctactacgagttacgaccgtcgtcgaccgtctacgtagttacgtacgtttactaccgaaaccttacttaacgttaccgaccgtaaacctaattaaccgtacgtacgttaacttttaccgttttacgtttacccgtttaccggggttaccgggaacggggtaaacccggttaacgggtaacgggtaaccgtaccgtaaacgttaccggtaaaaccggtaaccggttacgtttacggggtaccgtccgtaacccggtaaccttaaccgttcgtttaccgtttacccgttaccctttaaccgttccctttaccccccggg

SEQ ID NO: 19172 - DNA, 746 bp, Homo sapiens
  misc_feature: GYAE6OF01EON19.35.10.A10.1.454.CMB.1.raw
  modified_base (163)..(163): a, c, t, g, unknown or other
  misc_feature (163)..(163): n is a, c, g, or t
tcagtacagatcgtcacgaccggtgctcgatttagcgtcgatctcagggggagtcagacccagtcaggacacagcatggacatggagggtccccgctcagctccgtggggctcctgctgctctggctcccgaggtcgaccaaatgtgacatccagctcgaccngtcctccctccaccctgtctgctatctaggtaggaagaacggctacaccatcacgttcgaccgacagtacagtagttagtagtagttggtacgtcgtaggtactcgacgacaacggaaaccgaagggaaccctaccctaactccgtagtacttacgttaaggcgttacgttaacgttaggaggtacggtccgggtacctagttacgtaacggttcgacggtcggactaggtaggacgttcgacggggaacctaggtaccttaccgacttcacctaccgactacccgaacgccgtccgtacgacccgtacgtacgtacgttaattacggtttaacgtttacgaacccttaaaccgttacgtttacgaccgtaaccgtaaatacgggtttagttacggtacgtttaacccgtttcccggttaaccgttaccccggttacccggggtaacccggttaacggggaaaccttaacgggttacgtaaccttaaccgtaaaccgtaaaccgtacggttcgggacttaccgacgtaacctaccgtacgttccgtactttacccgttactcccggtttccccgaccgttacg

SEQ ID NO: 19173 - DNA, 610 bp, Homo sapiens
  misc_feature: GYAE6OF01EWSSU.35.10.A10.1.454.CMB.1.raw
  modified_base (244)..(244): a, c, t, g, unknown or other
  misc_feature (244)..(244): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccggaccagtcagatattagtattggtgctgtatnagcaagaacgagggaaacgacccctaaactcctagtacttcgtttaaggcgttacttacgtttagagtacggtcggggtacccagtcgtaaggttcaggcggctaggtggtactcgtagggacagtacttcactctaccaccatccaccacgcctgccacgcctgattcgttatttcgacctaaccttattaccacgtaccaacttacttaacacgtactaacttttcgtttaccttaccggtttcgggacgggtaacgggtacccgtaagggtaggtaacctagtaccgaggtaaccgtacgttggtacggctcggacccaccgttacttccgttacgttacctttacctcttcccgttaccccg

SEQ ID NO: 19174 - DNA, 742 bp, Homo sapiens
  misc_feature: GYAE6OF01EB1B3.35.10.A10.1.454.CMB.1.raw
tcagtacagatcgtcacgaccggtgctcgatttagcgtcgatctcagggggagtcagacccagtcaggacacagcattgacatgagggtccccgctcagctccgtggggcctcctgctgctctggcctcccaggtgaccaaatgtgacatccagctcgacccagtcctcccctccacccctgtcctgcattctaggtagggagaaagccgtaccaaccattccacgttcggaccggacagtcagtagttattagtagttggtggtcctggtatcgagacgaaacgaaaccgaaggggaaacctacccctaaacgtcctagtacttacgtttaaggtccgttacttaacgtttaggaggtacggttccgggtacctagtacgtaaggtttcgaacggcggtacgtagggtacggtaattcggagggaactacgtaacctttccgacctttactacccgaacctacgttacccgaacccgacgtccctagggaccctcggtaccgtaggttaacgttcgtttaactttaccggaaccttaaaccttcgtttaacctacggaaaccccttaagtcgggttaagtttcggtaccgttacgtttaccccgttacgtttaccccggttccggtacccggtaacgggaactaaggttgtaactacgtaaacgtaaaccgtcggttagccggtatcccgtaacgacttccgttcggttaccttctaccttaccgttccccgtacccgtac

SEQ ID NO: 19175 - DNA, 707 bp, Homo sapiens
  misc_feature: GYAE6OF01D6D8J.35.10.A10.1.454.CMB.1.raw
  modified_base (258)..(258): a, c, t, g, unknown or other
  misc_feature (258)..(258): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctagtaggagaaagctcaccatccgacttcgccggacagtacagtagtatttaagtaagttggttcgccgtagtatnagacaagaaaccgaaggaaaccacccctaactctagtacttacgttacgcgttacgttaacgttagtggtacggttccgggtaccctaagtacgtaaacggttccgaggtcggtacgagggtacgtacgtacgtacggactacgtacttcgactcgtaccactactaccgacctacgtcgtcgaactcgtaccgtgtatttagtttactttaccgaaccttaaccctttagtacgtaacccgttaaaccaacgtttaacggtagtttacggttacgttaccgtttacccgtacccgttacccgtttcccggggtaaccccgttaaagggtaaaccgtaaagggtaccttaagtaaccgtaaacccgtaaacggttagtacggttacgcttacgaccttacgttacgtccgtttaccgtagttacccttacgttcccgttaccctaaccg

SEQ ID NO: 19176 - DNA, 624 bp, Homo sapiens
  misc_feature: GYAE6OF01B2SJ0.35.10.A10.1.454.CMB.1.raw
  modified_base (216)..(216): a, c, t, g, unknown or other
  misc_feature (216)..(216): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctcccctccaccctgtctgcatctgtaggagaagcgtcaccatcacttgccgaccngtcagatattagtattggttgcctggtatcagcaagaaaccgaggggaaacacccccgtaaactccctgacttcgtttaaggcgttacttacgtttagaggtacggttcggggtcccagttacgtaaggtttcgacggcggtcagggtcggatcggtaggggacctaggtaccttacaccgttctaccacctactccgacccacgtcctgccacgtcctgattgtatttcgactaaccttattactacgaccaacgtagtacgttggtactacgttcccgtacttacccggtttccgggacccgttagggaaccgttaaacgggtgtaacgtactaaccgtaaacgtacgttggcggtactcgaccaccgtacttcgttcgttcttacctcgttcccttcccggtacc

SEQ ID NO: 19177 - DNA, 610 bp, Homo sapiens
  misc_feature: GYAE6OF01COHXC.35.10.A10.1.454.CMB.1.raw
  modified_base (148)..(148): a, c, t, g, unknown or other
  misc_feature (148)..(148): n is a, c, g, or t
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (430)..(430): a, c, t, g, unknown or other
  misc_feature (430)..(430): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggcctcccgagggtcaccaaatggtnacatccaggcctgacccngtcctccccnccacccgtgtctgcatctggaggacacaggatcaactagttactggtcgggcagtgagataataagttgtggttgctggtatcgagacaagaaaccaagggaaacgacccctagtaactcctagataggttagtacggtcgtcttacggttacaaacgtaaacgtacggggttacccacgaacggttcacggacggcaaggtggattcggagggaacactaattccaactctactaacgactacagtaacgccngacacgcctagtatatacgtttacacttaattagtactacgaccaaagtaacgtaattaaacgtacgtttaaccctcttaaacgtttcggacgggttaacgggaaccaaggtaacgaacgaaccaacgaaccgtgtacggcgtagacacctgactcgtccttacgatcccgtccgtcacg

SEQ ID NO: 19178 - DNA, 743 bp, Homo sapiens
  misc_feature: GYAE6OF01AQWEX.35.10.A10.1.454.CMB.1.raw
  modified_base (417)..(417): a, c, t, g, unknown or other
  misc_feature (417)..(417): n is a, c, g, or t
tcagtacagatcgtcacgaccggtgctcgatttagcgtcgatctcagggggagtcagacccagtcaggacacagcatggacatgacgggtccccgctcagcgtcgttggggcctcctgctgctctggctcccaggtgccaatgtgacatccagctgaccctagtcctccctccaccctgtcctgacctactcgtaggtacgggaacgaaacgccgtaccaccacttaccgaaccgttcggaccgaccagtcacgtagttattaagtaattggtggtacctaggtactcacgtacaagtaaaccgaacgggaacctaccctaaacgtccgtagtacgttacgtttaacggctacttacgtttagagtacgtcggtaccctagtactacggtacacgtcggactaggtcgagttccggnggaacctgtaaccttcgtacctacctaccaccgtacgtacccaaccgcggtacctagaccgtacgtaccgtaggtaacgttagttaccgtttacgaaacccttaacgttaacgttacgtacggtaacctaacggtagtttaaccgtttggtaaccgtttccgttttaccggtacttacccggttaccccgggtaccggttaacgggttaaaccgtaagggttaccaaggttaccaaccggtaaaaccgtaaccggttggtaaccggtaccgtcctaaccgtaccttaactccgttaacgtctaccgtcgtttacccgccccggtac

SEQ ID NO: 19179 - DNA, 682 bp, Homo sapiens
  misc_feature: GYAE6OF01BEWRX.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctcgacccagtcctccctccaccctgtctgcatctgtaggagaagcgtcacatcacttcgccgacagtcagagtattagtattggtgctggtatcagcaagaaaccgaggaaacgacccctaaactcctagtacttacgtttaacggcgttacttaacgtttaggaggtacgggttcggggtaccctataccgtaaagggtttcgaaggcggacgtaggtacggagtcggtaggggacacgtacttcactcctaccaacctactaccacccgtacgcctcgacctacgtccgttagattcggttattttcggaacccttaaacctttatttaccgtcgaacccgtaattacgttagttcgggttattaccgtttcccgttaccgttaccggtttcccgggacccgttaagggaacccgttaaggtacggtaacttaacgtaaccgtaaacggtaacgttgggtacggtactacggaccctaacccgttattccgtacgtttaccttaccgtacctttccccgttccccgacc

SEQ ID NO: 19180 - DNA, 616 bp, Homo sapiens
  misc_feature: GYAE6OF01A7JDF.35.10.A10.1.454.CMB.1.raw
  modified_base (266)..(266): a, c, t, g, unknown or other
  misc_feature (266)..(266): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccgaccagtcagagtattagtattggtggctggtatcagcaagaaaccgagggaacncccctaaactcctgattcgtttaacggcgttctacgtttagagtaggtcgggtcccagtcaaggttcagcggcagtgatcgtggacagtacttcgactctaccacctactccaccacgtccctagtaccacgtcctaggtattcggttattttcggacctaaaccttattactcgaaccctaagtacgttagttcgggtgttaccgtttccggtaccttaccggtttcccggacccgttacgggaaccctaaggtcgtaatacgtaacgaaaccggtacgttcggtacgccgtacgacctaaccgtacgttccgttacgttcccttactaccgttcccttccccgtaccg

SEQ ID NO: 19181 - DNA, 835 bp, Homo sapiens
  misc_feature: GYAE6OF01BJ84F.35.10.A10.1.454.CMB.1.raw
tcagtacagatcgtcacgaccggtgctcgatttagcgtcgatctcagggggagtcagacccagtcaggacacagcatggacatggagggtcccgctcagctcctggggctcctgctgctctggctccaggtgccaaatgtgacatccagctcgaccagtctccctccacctgtctgcatctgtaggagaagcgtacacatacacttcgccggacagtcagatattagtagttggtgtctggtatcagacaagaaaccgaacgggaacaccccttaaacgtcctagtacgttacgtttaacggtccgttacttaacgtttaaggacggtacggttacgggggtaccctaacgttacgtaaacgggtttcgaacgggtaccgggacgtaggtaggtacgttacggtacgggggtaaccacggtaacctttaccgtaaccttaccttaccgaacccgtacttacccgaaccctaccggtaccgtacggaccgtaaccggtacccgttaggtaacgtttacggttaacgtttttacggaacccttttaaaccttaacggtttaaccctaacggtaaccctaaacgttaacgggttaacgtttacgggttacgttaacggttttaaccccggttacgttaacccgggttttaccccggggtacccggttaacggggttaaacccgttaaaacgggttcgggttaaaacttaacccggtttaaaaccgtaaaacggggttaaccgtttagggtacccggtaacgtttaccgacccgttaaacccttatttaccccgtttaggtttcccttacctaaccgtttcccccgttaacccgtaccc

SEQ ID NO: 19182 - DNA, 576 bp, Homo sapiens
  misc_feature: GYAE6OF01ERBZE.35.10.A10.1.454.CMB.1.raw
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcactgccgacngtcagagtattagtatggtgctgtatnagcagaaccaggaacgacccctaacgtcctagatcgtttaaggcgtctacttagagaggttcgggtcctatcgaagttcaggtcggcaggtggatcggtggacagtacttcactcacacacgccaccncgcctgaccacgtcctagtatgtactttacgacctaactacttactcgtaccaacgtagtataggtagtaccgttccgttaccgtaccgtttccggacccgttacgggaaccgtaaggtcggtaatacgtaacaaaccgtagttacgtcggtactacggcctaccgtattcgttacttacccttactaccttccccttccggtaccc

SEQ ID NO: 19183 - DNA, 631 bp, Homo sapiens
  misc_feature: GYAE6OF01BYZB6.35.10.A10.1.454.CMB.1.raw
  modified_base (96)..(96): a, c, t, g, unknown or other
  misc_feature (96)..(96): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
tcagtacagatcgtcacgaccggtgctcgatttagcgtcgatctcagggggagtcagacccagtcaggacacagcatggacagtgagggtccccgntcagctcctggggctcctgctgctctggctcccaggtgccaaatgtgacatccagctgacccagtctccctcaccctgtctgcatctgtagganaagcgtcacatcacttgccgacngtcagagtattagtagttggtgcctggtatcagcagaaacagggaaacgacccctaaatcctagactacgtttaaggccgttactacgtttagagtacgtggggtacccatacgaaggttcaggcggtcaggttcggatcgtgggacagtacttcgacttcgacaccgtataccaccacgcctagcccagtcctagtatgttacttacgactacgttatacgtctaaccaacgtagttatcggtagtactttcccgtactacccgtttccggtaccccgtacgggaaccttaacgggtagtaacgttaactaaccgaaaaccgttacgttaccggttggacccgttacggtaacccacccgttaactttccggtaccgttttactaaccttacccgtttacccgtttcccgtaacccg

SEQ ID NO: 19184 - DNA, 631 bp, Homo sapiens
  misc_feature: GYAE6OF01EZFC7.35.10.A10.1.454.CMB.1.raw
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggacagtcagagtattagtaattggttaggcctggtatcagcaagaaaccagggaaacgcccctaaaacgtcctaggactcgtttaaggcgttactactttaggagtagtcggggtcctaagtcgtaaggttcaggcggacaggtggagtcgngggacagacttcactctacacatcaccagcctgacagccngtatagtatttcgactaaacctattacgtcgacctaaactacgtagtggttacgtacgtttacccgtacttacccgttttccggaccccggtttacgggaaaccttaaacgggttaacgggtattaacgtaacgtaaaacccgaaacgttcgggttagacccttaggccctaaccgtaacttccgttaccgttctttacctaccgtttcccgttcccccggtaaccc

SEQ ID NO: 19185 - DNA, 557 bp, Homo sapiens
  misc_feature: GYAE6OF01DH1PC.35.10.A10.1.454.CMB.1.raw
  modified_base (353)..(353): a, c, t, g, unknown or other
  misc_feature (353)..(353): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (522)..(522): a, c, t, g, unknown or other
  misc_feature (522)..(522): n is a, c, g, or t
  modified_base (537)..(537): a, c, t, g, unknown or other
  misc_feature (537)..(537): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctcgacccagtctcccctccaccctgtctgcatctaggtaggagaagcgtacaccatcacttcgccgacagtcagagtatagtattggtgctggtatcagacaagaaccagggaaacgcccctaaactcctagtacttacgtttaacggcgttacttaacgtttaggaggtaggtcggggtaccagtacgaaggttcaggcgntagtggatcgtaggacagtactcactctcacatcacagccngcncgcctgatgtatttcgactactatactcgacaactgttatggtatcttaccgtctaccgttcggaccgtagggtaacctaaggtgtaagtactaacgaaaccgtagtcggtggctagccaacctnttactcgttaccttntaccttcccgttacccgacc

SEQ ID NO: 19186 - DNA, 864 bp, Homo sapiens
  misc_feature: GYAE6OF01C9XF9.35.10.A10.1.454.CMB.1.raw
  modified_base (99)..(99): a, c, t, g, unknown or other
  misc_feature (99)..(99): n is a, c, g, or t
  modified_base (170)..(170): a, c, t, g, unknown or other
  misc_feature (170)..(170): n is a, c, g, or t
tcagtacagatcgtcacgaccggtgctcgatttagcgtcgatctcgagggggagtcagacccagtcaggacacagcatggacatggacggggtcccccnctcagctccgtggggccttcctgctgctctggcctccgaggtgaccaaatgtagacatccagctcgacccngtcctcccctccaccctgtctgactagtctaggtaaggaacgaacgtctaccacctattccacgttcggaccggaacctagtacgaagtaagttaagtttaaggtttaagttggggttacggaccgttaggtaactccgaagaaccgaaaggaaaccggaaccggggaaacctacccctaaacgtccgttagtaacgttttaccggttaacggtaccgtttaccgtttaaacgttagggtaacgggtacgggtttacccggggtaaccctacgttaaacggttaaccgggttaccggaagggtaccgggtaacggttacgggttacgggtaacgttacgggttaacggggaaacccgttacggtttaacccttaccggtaacctttacccttaacccgaaacccgttaaccaccctaaacccggttcgacccggttacgaacccgtccgtaccgttaggtaacgtttacgttttaacgtttacccgaaacctttaacctttaacgttaccaaccgtaaccgtaacgttaggttacgttaggtacgttaccgtttacccgtaccgttcccgttaccgggtaccgtaaagggtacgtaaggtacgtaaactacgtaacgtaaccgtaggtcgtacggactaccgcttaactcgtttaccgtcgttaccttaaccgttactccccgttaccgtaccc

SEQ ID NO: 19187 - DNA, 764 bp, Homo sapiens
  misc_feature: GYAE6OF01BBFR2.35.10.A10.1.454.CMB.1.raw
tcagtacagatcgtcacgaccggtgctcgatttagcgtcgatctcagggggagtcagacccagtcaggacacagcattgacatgagggtccccgctcagctcctgggctcctgctgctctggcctcccaggtgaccaaatgtgacatccagctcgacccagtcctcccctccaccctgtctcgcatcgtaggtaggaagaaacgcgtcacctatcctacgttcggacccggaacctagtacgaagtaagttaatttaggttaagtttgggttcggtcctagggtatacacggacaaacggtaaaaccgaaggggtaaaccgtacccccttaaaacgtcccgtagtactttaacggttaacggcgttacgttacgtttaggacgtagggtcgggtacccagttacgaaggttcaggcgtagtaggtaggtatacggtacgggactagtacctactaccttacctaccaacctactaccaccgtaccgtccgtagacccgtacgtccgtagttaacgtttcgtttaacgtttacccgaaccttaaccgtttattaccgtaccgaaccctaaagtaccggttagttacggttacttaacccgttcccgttaccggttacccggttcccgggaaccgttaacgggtaacgtaacggtagtaaaccgttaacgtaaccgtaaaccgttcggttcgggacttcccgtaacgcccgttaaccttacgttacctttccgttaaccgtttcctacgtttcccccgtcccgtac

SEQ ID NO: 19188 - DNA, 614 bp, Homo sapiens
  misc_feature: GYAE6OF01BDRXA.35.10.A10.1.454.CMB.1.raw
tcagtacagatcgtcacgaccggtgctcgatttagcgtcgatctcagggggagtcagacccagtcaggacacagcatggacatgagggtcccccgctcagctcctggggctcctgctgctctggctccaggtgccaaatgtgacatccagctgacccagtcctccctccaccctgtctgcatctgtaggagaagcgtcaccatcacttcgccggacagtcagtatattagtaagttggttgcctggtatcagcagaaaccagggaacgcccctaaactcctagtactcgtttaaggcgttactacgtttaggagaggtcggggtccagtcgaaggttcaggcgactaggtaggtatcgtagggactaggtaccttcgactcctacacctactaccaccacgtcctcgcgacgtccctgattgtacgtttcgacctaaccgttattaccgtcgacccgtaacgagtttagtacggttacgttacgtttcccgtacttaccggtttcccggacccgttacgggtaaccctaaggtcggtaactagtaacgaaaccgtagtcggtcggtactggccctacacttcgttcgtaccttacgacttcccgtccgtacccg

SEQ ID NO: 19189 - DNA, 674 bp, Homo sapiens
  misc_feature: GYAE6OF01D1DLU.35.10.A10.1.454.CMB.1.raw
  modified_base (204)..(204): a, c, t, g, unknown or other
  misc_feature (204)..(204): n is a, c, g, or t
  modified_base (410)..(410): a, c, t, g, unknown or other
  misc_feature (410)..(410): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggcctcccagggtgccaaatgtgacatccagctcgacccagtcctccctccaccctgtctgcatctgtaggagaagcgtcacntcacttgaccgaccagtcagagtattagtattggtgctggtatcagcaacgaaccgagggaactaccccctaaatcctgtacttacgttaaggccgttacttacgttaggaggtaggtcgggtcctagtacgtaaggtcaggcgacgaggtagacgtcgtagggactagtaccttcacctctcgacctactaccacacgctcgacncgtcctagacttgtagtttacgaccttaaccttacgttactacgtacccaagttaggttagtacggttaccgttactttaccccggtttaccttaacccgggttttacccgggtacccggttaaccgggttaaaccgtaagggttcggtaactaaccggttaaccgaaaaccggttacgttcgggtacgtaccgttcgacccgtaaccgtactttcccgttcgtttaccccgttattaacccctttccccgtaccccgttaccg

SEQ ID NO: 19190 - DNA, 922 bp, Homo sapiens
  misc_feature: GYAE6OF01AB2IV.35.10.A10.1.454.CMB.1.raw
  modified_base (183)..(183): a, c, t, g, unknown or other
  misc_feature (183)..(183): n is a, c, g, or t
  modified_base (433)..(433): a, c, t, g, unknown or other
  misc_feature (433)..(433): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggctcccaggtgaccaaatgtgacatccagctacgaccctagtcctaccctccacctgtcngtcatcgtaggtaggaagtaacgcgtaccacctattaccgacgttcggacccggtaacagtacgaagtagttaacttaagttaagttcgggttcggtaccgtaggtactaccgagaacgaaacggtaaaccggaacgggaaacctacccctaaacgtcctaagtaaccgtttacggtaacggtccgtactttaaacggttagaggttacggttaccgggtactaacgtacggtaaacggttcgaccgggnggactaaggggttaccgtagtaccgggtacggaataccggtacttacacccgtttaacacccgaactaacctcccaaccggtaccctaccgggtacaaccggtacgacccgtttagtcggttttaaacgtttacgttaccccgtaaaacgttaaaccctttaccgggtttaaccgtaaacccgtaaacccgttaaacgtttaaccgggtttaggtttaaccgggtaacccggttttaaccggtttccccgtttaaaccgggttacccccgggtttaccgggggtacccccggttaaaacggggggtaaacctaacgggggtttaaacaacccggtttaaaaacctaacccgggttaaaaaccgggtcgttaccgggtaaaccggggttccccttaaaccggggaccccttaaaccttacccggtttaccgtttaacccgttttagtaccccccggttaactttccccccggggtaccctaaacccccgg

SEQ ID NO: 19191 - DNA, 686 bp, Homo sapiens
  misc_feature: GYAE6OF01A2IAF.35.10.A10.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagtacagatcgtcacgaccggtgctcgatttagcgtcgatctcaggggggagtcagacccagtcaggacacagcatggacatgagggtccccgctcagctcctggggctcctgctgctctggctcccaggtgccaaatgtgacatccagctgacccagtcctccctcaccctgtctgcatctgtagganaagcgtcacatcacttcgccggaccngtacagagtattagtattggtgctggtatcagnagaacaggaactaccctaactcctgattacgttaaggctacttacgtttaggagtaggtcgggtcctagtacgtaaggttcaggcgacgaggtcggaccgtaggacagtactcaccgtctacgactactaccacacgctacgacgacgtcctagtatacgttactttacggaaccctaaacttacgttaccgtacgaaccctaaaggtacggttacgttacggttacggttaccgtttcccgtaacgttacccggtttcccggacccgggttaacggggaaccttaaaggggtcgttaaacgttaccgtaaaccggttaaaccggtaacggtccggttagggtccctttaggaacccccttaaccggttattacccggtttccgttaaccctttccggtaacccttttccccccgggtaccccggtacccttaacg

SEQ ID NO: 19192 - DNA, 597 bp, Homo sapiens
  misc_feature: GYAE6OF01E3ZZF.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcaccatcacttgccggaccagtcagagtattagtaattggttggcctggtatcagcagaaccagggaaacgcccctaaactctagatctttaaggctctacgtttagagaggtcgggtcccatcgaaggttcaggcggcgtaggtggtactcgtggggacagtacttccactcctaccacctatccaccacgtccctcgcacgcctgacttgtatttcgactaaccttattactcgacctaacgtagttacgttggtacgtactttcccgtacgtacccgtttaccgggcccgttagggaaccctaaggtcgtaatactacgaaaaccgacgttggtcggtactacgtcctacccgtagttccttacgttcccttacctaccgttccccttccccgtaccg

SEQ ID NO: 19193 - DNA, 742 bp, Homo sapiens
  misc_feature: GYAE6OF01BI53H.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggcctcccaggtgccaaatgtgacatccagctgacccagtcctccctccaccctgtctgcatctgtaggagaagcgtcaccatcacttcggccgaccagtcagagttattagtagttggttggctggtatcgagacaagaaacgagggaaaccaccctaaacgtcctagtacttacgttaacggtcgttactacgtttaggaggtaggtcggggtaccctagtacgaaggtttcaagggcggtacgagggtggactcggtacgggactacggtactaccgtacgttcacctaaccgtactaccgaacccgtacggcccttaggaccctacgccgttagtaacgttagttaacgttttcgaaaccttaaacccgtttatttaccgtaccgtaaccctaaggttacgttacgttacggtccgtttaccgtttcccggttaccttaccgggttttacccgggacccggttaaacgggaacccgttaaagggtacgggtaacctttaaacggtaacccttaaaaccggggtaacgttccgggttacggtacccgacggtacccctaacgttagttacccgttcgtttaccttacccggtactttccccccggttccccgtaaccg

SEQ ID NO: 19194 - DNA, 841 bp, Homo sapiens
  misc_feature: GYAE6OF01AR2UN.35.10.A10.1.454.CMB.1.raw
tcagtacagatcgtcacgaccggtgctcgatttagcgtcgatctcagggggagtcagacccagtcaggacacagcatggacatggacgggtccccgctcagcctccgtggggactccgtgctgctctggcctccgaggtgccaaatgtgacatcccagctcgacccagtcctcccctccaccctgtctgcatctgtaggagaagcgtcacatcactgccgacagcagtgtattagtaattggtcgcctggtatacgagcgaacgaaaccgagggaaacgacccctaaactccgtagtacgttacgtttaacgggccttacgttaacgttaggaggtacggttccggggtaccctaagttaccggtaaacggtttccgaacgggccgggtacgtacggggttacggtaccgtttaccggggtacggggtaacctaaacggttacctttacccgtaccgtttacccgttacccgaaccctaaccgttacccgtaaaccccggtcgttaccccgtacggtacccgtaccgtcccggttacgtaacggtttacggtttaaccgttttaccggtaaaccctttaaacccgttttaccgtaaccgtttaccgtaccgtaaacccggtttaaggtaacggttttaaccggaggttttacccggtttaccgtttaaccgggttcccgtttacgggggaacccgggttaaacggggtaaccgtaacggggttacgaaccgaaccggttaaacgtaaaaccgtacggttacggtcggaccttacggcctaacccggttagttcccggttaccgttacgttaccgaacccgttttcccccgaccgttacccg

SEQ ID NO: 19195 - DNA, 715 bp, Homo sapiens
  misc_feature: GYAE6OF01DHBYX.35.10.A10.1.454.CMB.1.raw
  modified_base (283)..(283): a, c, t, g, unknown or other
  misc_feature (283)..(283): n is a, c, g, or t
  modified_base (405)..(405): a, c, t, g, unknown or other
  misc_feature (405)..(405): n is a, c, g, or t
  modified_base (667)..(667): a, c, t, g, unknown or other
  misc_feature (667)..(667): n is a, c, g, or t
  modified_base (708)..(708): a, c, t, g, unknown or other
  misc_feature (708)..(708): n is a, c, g, or t
tcagtacagatcgtcacgaccggtgctcgatttagcgtcgatctcagggggagtcagacccagtcaggacacagcatggacatgacgggtccccgctcagctccgtggggctcctgctgctctcggcctcccgaggtcgacctaaatgtgacactccgagctacgaccctacgtcctcccctcccacccgtgtcctgcatcgtaggtaggaacgaacgccgtaccacctactcctacgttcggaccgacctagtcgaagtagtattagtagttggtgctgtancagacaagaaccgaggaaccaccctaactctagtacttacgttaagtctacttacgtaggagtacggtcggacctagtacgaggtcaggcgacaggtgtagtggtacggactactaccgtcnctaccacctacctacgtacccaccgagtccccgtagaccgtaccgtccgttagtacgtttacgtttaacttaacccgaaaccttaacccgttaagtttaccccgtacgtaaaccgtaacggttagttaggttacgggttaccgttttaaccccgtttccgtaccggtttaaccccggtttccgggaacccccgggttaaaggaacccttaaggggtcgtaaactaacccgaaggtaaacctccgttaggggctcccggttanaaacctcccgttatccgttctaccctttacaccgttccccnccgtaac

SEQ ID NO: 19196 - DNA, 772 bp, Homo sapiens
  misc_feature: GYAE6OF01CM8J1.35.10.A10.1.454.CMB.1.raw
  modified_base (135)..(135): a, c, t, g, unknown or other
  misc_feature (135)..(135): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggcctcccaggtnaccaaatgtgacatccagctcgacccagtcctcccctccaccctgtcctgcatcgtagaggagaagcgtacaccatccactcgaccggacagtcaagtagttaattagtagtggtacgctagtatcagacaacgaaaccgaggaaccaccccgtaaactccgtagtacttacggtttaacggtcttacgttacgttagacggtaggtaccgggtacctagtacggtaaggttccgaaggtcggacgtaaggtcgacgttacggtaggaacagtaccttacgacttaccacaacgactaacccaccgtacgtccgtacgaccgtaacgtccgttaggtaactttaggttacgtttaacgaaccctttaaaccggttcttaaccgtaccgaacccgtaaagttaggttaacgtcgggttaacgtttaccgtttacccggttaccgttacccgtttaccccgggaccgttaaacggggaaacccttaaagggttacggttaaaccaaaacgggttaaaccggtaaaaccggttaaccggtttcgggaacgttacccgtaacccgtaaccttaaccgtaccgtttaacgttaccgttttaccaacccttttaaccccggttacccgttacccccggtaacc

SEQ ID NO: 19197 - DNA, 737 bp, Homo sapiens
  misc_feature: GYAE6OF01A0G72.35.10.A10.1.454.CMB.1.raw
  modified_base (413)..(413): a, c, t, g, unknown or other
  misc_feature (413)..(413): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggcctcccgaggtcgaccaaatgtgacatccaggcctcgaccctacgtcctcccctcccaccctgttctgctatcgtagtaaggaagtaaacgccgtacacctatcctacgttcgaccgtacagtacaagtagttattaggttaagtttcgggttcggtccgttaggtactcgaagaccgaaaacgaaaccggaacgggaaacctacccctaacgtcctagtacttacgttacgcgttacgtaacttggacgtacggtcggtaccagttacgtacggttcgacggacggtntagggtagacgtgggtaacggactacgtacctacgtacctcctaccaacctactacccgaaccgtacgtcccgtagaccgtacgtccgttagtacgtttaccgttaattcctaacccttaaccgtttactaccggtcgaaaccttaagtacggtttacgtcggtaccttacgttcccgttccgtttaacccggtcccggtaccggtaaaggacctaaagggtcccgtaataacccgtaaccgaaattacggttcgggcgtaccctggaccccacgtttatttcggtacccttacttaccggtaccctttcccgacgttaacccg

SEQ ID NO: 19198 - DNA, 760 bp, Homo sapiens
  misc_feature: GYAE6OF01BT8WO.35.10.A10.1.454.CMB.1.raw
  modified_base (550)..(550): a, c, t, g, unknown or other
  misc_feature (550)..(550): n is a, c, g, or t
tcagtacagatcgtcacgaccggtgctcgatttagcgtcgatctcagggggagtcagacccagtcaggacacagcatggacatgacgggtccccgctcagctccgtggggctcctgctgctctggcctcccgaggtcgacctaaagtgtgactatccagctcgaccctacgttccctcccctcctaccctgtctgctatcgtaggtaaggaagaacgccgtaccacctactctaccgttcgaccggactagtacgaagtacgttagttaggttagttgggtcgtcgttaggtactacgaagaaccgaaacggaaaccggaacgggtaaaccctaccccgttaaactcgtaagtactttacggttacggtccgttacgttaacggttaggacggtacgggttccggtaaccagttacggtaggttcgacggcggtacgtaggtcgtacgtcggtaaggacctagtaccgttcgtaacctcctaccaactacctaccgaccgtacgctacgcctacgtacgtagttacttgtaactttcaacctttaacgtnttaccgacgtaaacctaaggtacgtttacggtacgttaccgttaccgttccttacccggttccgggttacccgtacccgggtaaaggtaaccgttaagtacggttaaacgtactaacccggtaaagtcggtagggttccgacgttaccggaactacccgttacgttcgtttacccgtctttaacccgccggtttcccgtacccgtaaagg

SEQ ID NO: 19199 - DNA, 870 bp, Homo sapiens
  misc_feature: GYAE6OF01C0GPT.35.10.A10.1.454.CMB.1.raw
  modified_base (539)..(539): a, c, t, g, unknown or other
  misc_feature (539)..(539): n is a, c, g, or t
tcagtacagatcgtcacgaccggtgctcgatttagcgtcgatctcgagggggagtcagaccagtcaggacacagcatggacatgacgggtccccgctcagctccgtggggctcctgctgctctggcctccgaggtcgacgaagtgtgactatacgaaatcgaacccagttccttcccttcccacccgttgtctacgctacgttcgtgggttacgggacgacggacgtcgttacactcgtaacgttccgtaccgttcgccgtacggtaccgtacgttcgaacggtaacgttagttacggtacgttaacgggtttcggtttccgggtaccgttagggttaacacgaacgaaccgaaaacgaaacccggaacggtaaaaacccaaaaaccccgttacgtaccgttaagtaaaacgtttaacggtaccggtacctttaaccgttaaggttttaacggaacggggttaccgtacccaggtaacggtaacggttcgggagtacggtaggtagtacgcggtagacttagtaccttcgacttcaacncgtatcagacctacgcgacgtacgtacgtagtacgttactacgtactttaacgtccgttactacgtaactaacgttacgttaacttaaccgtttaaccgtttaacccgttacggtttaaccgggtaacccgggtacgggtaaccgggttaaactaaaccggggtttaacggaaaccccggttaaaacccggtaaacggtttaaacgccggggtttaaccggtaacctaccgggtaacccgttaaccgttaacggtttacccgtttacccggttacccgtttaacgggtttacccccttacccgtaccccgtaacggttcgttaaacccggg

SEQ ID NO: 19200 - DNA, 758 bp, Homo sapiens
  misc_feature: GYAE6OF01ADKYN.35.10.A10.1.454.CMB.1.raw
  modified_base (235)..(235): a, c, t, g, unknown or other
  misc_feature (235)..(235): n is a, c, g, or t
  modified_base (713)..(713): a, c, t, g, unknown or other
  misc_feature (713)..(713): n is a, c, g, or t
  modified_base (724)..(724): a, c, t, g, unknown or other
  misc_feature (724)..(724): n is a, c, g, or t
  modified_base (743)..(743): a, c, t, g, unknown or other
  misc_feature (743)..(743): n is a, c, g, or t
  modified_base (745)..(745): a, c, t, g, unknown or other
  misc_feature (745)..(745): n is a, c, g, or t
  modified_base (752)..(752): a, c, t, g, unknown or other
  misc_feature (752)..(752): n is a, c, g, or t
tcagtacagatcgtcacgaccggtgctcgatttagcgtcgatctcagggggagtcagacccagtcaggacacagcatggacatgagggtccccgctcagctctgggctctgctgctctggctccaggtgccaaatgtgacagtccagctcgaccagtcctccctccaccctgtctcgcatcgtggtacggaagaaacgtccgtcaacctactcctacgttccggaccggtaaccncgtacgagtacgttagtttaggttaattgggttacggtcttaggtactcgaacgacaacggaaacccgtaaggggaaaccctaccccccgttaaaacgtccgtagttaacgttaccggtttttaaccgggaccgtttacttaaccggttttaaggaacgggtacggttcggggtacccaagtccgttaagggttaccgacgggtcggacgtagggtacggtaccgttaggtaccggggactacgtacccctttcgaacttccctaccgacccttaaacgtccaaacccgtcggtaccgtacgtccgtaccggtaccgttacggtacgtttagtttacggtttacccgaactttaaacccgttaacttacccgtaacgtacccgtaatacggttacggttacgtacgtttcttccgttaccctaccgggtttacccgaccggtaacgtacgtaagtacggtaacttacaacgtaaccgngtacgcgtacncgctacacttcgtcttacncnctttccncgttac

SEQ ID NO: 19201 - DNA, 580 bp, Homo sapiens
  misc_feature: GYAE6OF01ALBNE.35.10.A10.1.454.CMB.1.raw
  modified_base (411)..(411): a, c, t, g, unknown or other
  misc_feature (411)..(411): n is a, c, g, or t
  modified_base (522)..(522): a, c, t, g, unknown or other
  misc_feature (522)..(522): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctcaccctgtctgcatctgtaggagaaagcgtcaccatcacttgccggaccagtcagagtattagtaattggttggcctggtatcagcagaaaccaggaacgacccctaactcctgatcgtttaaggcgtctacttagagaggtgggtcccatcaaggttcagcggcagtggatcgtgggacagtacttcactctcaccatccaccagcctgccagtcctgattgtattttgacctaacttattacncgaccaactagtactggtcgtaactttccgtactaaccgttttccgggacccgttgggaaaccctaaaggttcggaacttactacgtaaaaccggtaacttgggttacggnttacggcccaaaccgtattccgttcggttaccttccaacgtttcccgtttccccggac

SEQ ID NO: 19202 - DNA, 792 bp, Homo sapiens
  misc_feature: GYAE6OF01AY33B.35.10.A10.1.454.CMB.1.raw
  modified_base (747)..(747): a, c, t, g, unknown or other
  misc_feature (747)..(747): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggctcccaggtgccaaatgtcgacatccagctgacccagtcctccctccaccctgtctgccatctggtacggagtaacgcgtaccaccatccacgttgccggaccagtcagtattattagtaattgggtgctgtatcagcaagaaaccgaggggaaacctacccctaactccgtagacttacgtttaaacggccgttacttacgttaggacggtacggttcggggtacccctaagttccgtaaaggttccgaaggtccggtacgtaacggttggtaacgttccggtacgggggtaacctaacggtacccttcgtaaccgtccgttaacccgaacctacttacccgaaacccgtaaccggtcccttacggaccgtaccgggtacccctttaggaacttttaacggttaacgtttttaccgggaaaccctttaaaccgttaacgtttaacccgtacgaaccccttaaacgtaacggttacgttacgggttaccgtttaaccgtttccgttacccgttacccggtttccggggtaccccgttaacggggtaaacctaagggttacgtaaactaagttaacccgaaaccggttaacggtcggtaaccgttcccgagtacccaaccgttnttacccgttcgttacttccgtaacccttcccgtacccggtaaccc

SEQ ID NO: 19203 - DNA, 669 bp, Homo sapiens
  misc_feature: GYAE6OF01EK80S.35.10.A10.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
  modified_base (639)..(639): a, c, t, g, unknown or other
  misc_feature (639)..(639): n is a, c, g, or t
tcagtacagatcgtcacgaccggtgctcgatttagcgtcgatctcgaggggggagtcagacccagtcaggacacagcattgacatggacggggtcccccgctcagctccgtggggcctcctgctgctcgtggcctcccagggtcgaccaaagttggtanactatccagctcgaacccncgtcctcccctccaccctgtctcgcatcgtaggtaggaagaacgccgtaccaactctacgtacgtcgaccggacagtacgagtatagttagttagtggtcgtctaggtatacgacgacgaacgaaacgacggaacctaccctaactctagtacgtacgttaggaccttacttagtacgaggtcggtacggtacctagtacgtaacggtcaggaccgtagacggtcggacgtacgagggactacggtactctacgtcacgactcaccncgacgctaggctaccncgtattacgtaggttacttaaccgaccgtttaaactccgttacgactacgtaaggttacgttggtacggttcttacttcccggtaccaccggttcgaccggtagttaacgaacgtactaattaaccgtacgtaaccggtagtacggtacgcctcgtaaccgtaccttgtacccgtttntacccggttactcccttccggacccctacg

SEQ ID NO: 19204 - DNA, 786 bp, Homo sapiens
  misc_feature: GYAE6OF01B9SWB.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctcccctccaccctgtctgcatctgtaggagaaagcgtcaccatcacttcgccgacagtcagatattagtattggtgcctggtatcagacaagaaaccgaaggggaaaccgaccccctaaaactcctagattacgtttaacggcgttacttacgttaaggaggtaggttcggggtaccctagttacgtaaagggttcgaggtccggacgaggttggaagtcgtagggaacagtacctttcgaaccttcccttaccaaaccccgtataccgaaccccgtacgtacccgtacggtacctaaccggtcccttaggtagtttacggttaacttttttcggaacccttaaaccctttaagttttaacccgtaccggtaacccctaaaacgtaacggtttaagttacgggttaaccgtttaaccgttttccccgggttaacccgtttaccggttttacccccggggaccccggtttaacgggggttaaaaccccgtaaaagggttccggtaaacgttaaaccgttaaaccgtaaaaccggttaaccgttgggtaccggtacgtaccggtacctaacccgtacgtttcccgttacgttaccgtttacctaccttccccgttccccgtaaccg

SEQ ID NO: 19205 - DNA, 630 bp, Homo sapiens
  misc_feature: GYAE6OF01BDCNT.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgaccccagtctccctccaccctgtctgcatctgtaggagaaagcgtacaccatcacttgccggaccagtcagagtattagtatggttgcctggatcagcaagaaccaggaaacgcccctaactcctagactcgtttaaggcgtctactttagagtacggtacggggtcccagtacgaaggttcagcggacgtaggtaggagtcgagggacaggtacttccactactacctaccgactcctaccacgtccctgaccacgccctagagttagtacttttagacctaaacttacttactacgtaacccaacgtacggtattcggtacgtactttacccgtacgttaacccgtttccgggtcccgttacggggaacccgtaaaggtcggtaattacggtacctaaaacggtaaccgttcgtcggtactcgaccacccgttattaccgttagttcccttactacctttccccgtcccggtacc

SEQ ID NO: 19206 - DNA, 561 bp, Homo sapiens
  misc_feature: GYAE6OF01ARGJ3.35.10.A10.1.454.CMB.1.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (516)..(516): a, c, t, g, unknown or other
  misc_feature (516)..(516): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtattggtgcctggtatcagcagaaaccaggaaacacccctaactcctgatctttaaggcgttntacttagagtagtcgggtaccagtactagtcaggcgcgagtgntcgngggacagtattcactctcacctatccgagtacgcctagccacgtcctgatcgttactttcgaacttaaccttattaccgtacgaacctaactactttacacgtacttactttactttcctcgtttacgggccggtaggactaagggtcgactactagacgacgtaacgtggtacgngtcgaccgtactacgttcttgttaccttactccttcctacccccg

SEQ ID NO: 19207 - DNA, 598 bp, Homo sapiens
  misc_feature: GYAE6OF01AQO12.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcaccatcacttgaccgacagtcagagtattagtattggttggcctaggtatcagcagaaaccgagggaaacgacccctaaactctagacttacgtttaaggccgttacttacgtttagaggtacggtcggggtcccagtcgaaggtttcaggcggctaggtaggagtcgtagggacacgtactctactctacaccctataccaccagtccctgactagcctgtatgttactttacgacctaaccttattactcgacctaagtacgttagtcgtagtacttccgtactacgtttccggtacccgtacgggtaactaaggtgtaacgtactacgtaaacgtacgtaggtacggctacgccgtacctacgttcgttacgttccttactcttcccgttcccgtacc

SEQ ID NO: 19208 - DNA, 836 bp, Homo sapiens
  misc_feature: GYAE6OF01BDCNR.35.10.A10.1.454.CMB.1.raw
tcagtacagatcgtcacgaccggtgctcgatttagcgtcgatctcagggggagtcagacccagtcaggacacagcatggacatgagggtcccgctcagctcctggggctcctgctgctctggctcccaggtgccaaatgtgacatccagctgacccagtcctccctccaccctgtctcgcatctgtaggataagcgtacaccatcacttgccggaccagtcaggtataatttagtaagttgggttaggcctaggtattcagacaagaaaccgaggggaaacgccccctaaactccgtagtacttacgttttaacggccgttacttaacgtttaggaggtaacgggtcggggttacccagtaccgtaaagggtttccgaagggcccggtacttagggtacggtacgttacggtacggggaaccctaagggtttaccccttacgtaacccttcccggttaacctaacccgtaaacgttcctaacccgaacggtcccgttacggtccaaccggttccgttaacgttaccgttacggtttaaccgtttttacggtaacccgttaaaccccgtttaagtttaacccgtaccggtaaaccccgtaaatttaacggttaacgggttacgggtttaccggtttaaccgttttccccggttacccggttttaaccccggtttacccggggttaaccccgtaaccggggtaaacccgttaaagggttacggtaaaaccttacgtaaccgtaaaaccggtacgttaacgggttcgaaccgttacgggtcctaacccggtactttaccggttactttccgttaactccgttacccgttccggtaaccc

SEQ ID NO: 19209 - DNA, 609 bp, Homo sapiens
  misc_feature: GYAE6OF01EVAFU.35.10.A10.1.454.CMB.1.raw
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagtacagatcgtcacgaccggtgctcgatttagcgtcgatctcaggggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccggacagtcagagtattagtagttggtggcctggtatcagcaagaaaccgaggaacgcccctagactcctagatggtagtgggcgtcgtagttactaacgaaacggtcgggtacccacgtaaggttcaggcgacgaggtggatcggtaggactagtactcacttcaccactatnacggtacgtcctgaccncgtacgtagtactacgtacctttagacctaacgttacttacgaccgtacctaataacttacgacgtaccttaactttactttccgtacggtttccgggacgggtaacgtacggtaaggtccggactaacgtaccgaacggtaaccgtaacggtggtacggtccacggtacccaactacgttcgtacgtttcctcgttacttcccccg

SEQ ID NO: 19210 - DNA, 683 bp, Homo sapiens
  misc_feature: GYAE6OF01AMQ3W.35.10.A10.1.454.CMB.1.raw
  modified_base (152)..(152): a, c, t, g, unknown or other
  misc_feature (152)..(152): n is a, c, g, or t
  modified_base (184)..(184): a, c, t, g, unknown or other
  misc_feature (184)..(184): n is a, c, g, or t
  modified_base (267)..(267): a, c, t, g, unknown or other
  misc_feature (267)..(267): n is a, c, g, or t
  modified_base (408)..(408): a, c, t, g, unknown or other
  misc_feature (408)..(408): n is a, c, g, or t
  modified_base (637)..(637): a, c, t, g, unknown or other
  misc_feature (637)..(637): n is a, c, g, or t
tcagtacagatcgtcacgaccggtgctcgatttagcgtcgatctcaggggagtcagacccagtcaggacacagcatggacatgaggtcccgctcagctcctgggctcctgctgctctggctcccagtgccaatgtgacatccagctgacccngtctccctcaccgtgtctgcatcgtgtagganaagcgtcaccatcacttgccgtaccagtcagtagtattacgtaatggttacggcctggtatcagcacgaaaccgagggaaacncccctaaactccctggacttacgtttaacggtcgtaccttacgttttagaggtacgtcgggttccagttacaaggttcaaggcgtaccgtaaggttcggtacttccgtaggggaacctacgggtaccttcgacctttaccncaacccacttcccgaaccacgttccctcggacacgtccgtagtacgttacgtaacgttttcggaccttaaaccgttcttaacgttccgacctaaaccgtagttaccgtaggttacgtacgtttccgtaaccgttacccgtttacgacccgtaggggtaaccctaaggttcgaacggttaaccacgtaaacccgtaacggttcgtaacggtccgtacgacccgtaaaccncgttaccgttcggttaccttacccacgttcccgttccccgtaaccc

SEQ ID NO: 19211 - DNA, 722 bp, Homo sapiens
  misc_feature: GYAE6OF01A45SE.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgaccaaatgtgacatccagctcgaccagtcctccctccaccctgtctgcatcgtgtaggagaaagcgtacaccatcactcggccgaccagtcagtagtagttagtaagttggttggcgtaggtatacgagacaaggaaaccgaagggaaacctaccccctaaactcctagtacttaacgtttaaggacttacgtaacgtttaggaaggtacggttacggggtaccctaagtacggtaaaggttcgacggcggtacgaggtacggtagtacggtagggaacctaggtacccttactaccttacctaccaacctacaccgtaacccgacgtccctacggcctaacgtaccttagagtttacgttagtttaccgaaccttaaaccttacttaaccgtacgaacctaaacggtagttaagtcggtacgtaacccttccggtaccttaccgttacccgggtaccggtaacgggtaaacctaacgggtagtaacttaaacggaaccgtaaaacggtacgttgggtaccgtacgttacgaacccgttaactcgttccttacgtttacttaacccctcttcccccgtacccggtaccc

SEQ ID NO: 19212 - DNA, 789 bp, Homo sapiens
  misc_feature: GYAE6OF01CLCM7.35.10.A10.1.454.CMB.1.raw
tcagtacagatcgtcacgaccggtgctcgatttagcgtcgatctcgagggggagtcagacccagtcaggacacagcatggacatggacgggtcccccgctcagcctccgtggggcctcctgctgctcgtggcctcccgaggtcgacctaaagtgtgacactccgagctaccgaccctcgtcccctcccctccctacccgttgtcctcgctacgttcgtaggtaaggaagaaacggtccgtaccaacctacgtcctacgttacggacccggtaaccgtagtacgtaaggttagttaagttaggtttaggttcgggttcggtccttaggtactacgagaacgaaacggaaaaccgaacggggtaaccctaccccttaacggtctagttaacttacggtttaacggtccgttactaacgtttaaggcgggtacggtcggtacctaggtacgtaacggtcaaggggtccaggtagtacggtacgttcgggtaaggactacgttacccttcgacttaccacaactactcccgaacgtcgtccgtacgactacggtacctaggttacttacgttaactttcccgaactttaaaccgttacctacgtacccgtaaacgttaacgttaggtacggtttaacgaccggtttacccttcccggttaccggtttacccggttcccggaaccgggttacggtaaaccgttaaggtacaaacgttacgaaaccgtaacgtacggtgtaccgtctacctacgtaaccttcgtacttcttaccttcacccttccgtacccgtac

SEQ ID NO: 19213 - DNA, 661 bp, Homo sapiens
  misc_feature: GYAE6OF01EHION.35.10.A10.1.454.CMB.1.raw
  modified_base (437)..(437): a, c, t, g, unknown or other
  misc_feature (437)..(437): n is a, c, g, or t
tcagtacagatcgtcacgaccggtgctcgatttagcgtcgatctcagggggagtcagacccagtcaggacacagcatggacatgagggtccccgctcagctccgtggggctcctgctgctctggcctcccaggtgaccaaatgtcgacatccagctcgacccagtcctcccctccaccctgtcctgctatctaggtaggaagaaagccgtaccacctatcaccgttgcccggaccagtacagaagttagtttagtaagttgggtcggtcgtgtatcagacaacgaaacgaaggaacctaccctaaacgtcctagtactacgtttaacggtacgttacgttaacgttaggagtacggtcgggtaccctagtacgtaaggtcgaggcggactaggtacggtagtacgtagggactacgacttacactactaccactacncccacgacgtctgcacgctagtagttgtagttacaacctaacttactactacgaacctaagtagtaagttcggtacttaccttccgttaccgtaccggttccgggtaccgttaacggaaacggtaagtacggtaataacccgtaacgaaacgtacgttggtaccgtcgtacgaccctacttacgttaccgtcgtttaccttacgtacctttccccgtcgtaccg

SEQ ID NO: 19214 - DNA, 692 bp, Homo sapiens
  misc_feature: GYAE6OF01AF5F7.35.10.A10.1.454.CMB.1.raw
  modified_base (415)..(415): a, c, t, g, unknown or other
  misc_feature (415)..(415): n is a, c, g, or t
tcagtacagatcgtcacgaccggtgctcgatttagcgtcgatctcagggggagtcagacccagtcaggacacagcatggacatggacgggtccccgctcagctccgtggggctcctgctgctctggcctcccaggtcgacctaaatgtacgactactccagtcctcgacccctacgtccctccccctccctacccgttgttccgtgacctattcgttaggtaagggaagaacgtccgtaccacctactctacgttcggaccgacagtacagtagttagttagttagttggtcggtccgtagtacacgagacgaagaaccggaacggaaccctaccctaaactcgtatagttacgtacgccttatacgttaggaggtccggtcggtaccaagtcgtaacggttcgacgccgtaagngtcggtactcggaggacctactaccgttaccactccgtacacctaactccgaccacggtctacgacctacgtcgtagtacgttcgttattaccgtaaccttaccttactaccgtactaccgtaagtacgtagttacgtacttaccgttccgttaccggttaccggttaccgaccggtaaacggtaacgttaacgtacgtactaacgtacgtaacgtaggtacggtcgtagtccacctactactttcgtaccttcttacctaccttccctcccgtacg

SEQ ID NO: 19215 - DNA, 855 bp, Homo sapiens
  misc_feature: GYAE6OF01E2OI5.35.10.A10.1.454.CMB.1.raw
tcagtacagatcgtcacgaccggtgctcgatttagcgtcgatctcgaggggggagtcagacccagtcaggacacagcatggacatggacgggtccccgctcagctccgtggggcctcctgctgctctcggcctcccgaggtcgaccaaagtgtacgactactccacgctccgacccacgtcctcccctcccacccgtgtctgctatcgtaggaaggaacgaacgccgtacacctactcctaccgtcggacccggacctacggtacaagtagttaacgtttaaggttaagttcggggtttcggccttaggttaactaccgaacgaaccgaaaccggaaaaacccggtaacggggaaaaccccgttaacccccctaaaaccgtccggttaacgtacgtttaccggttaaacgggtctttaacgtttaacgttaaggacggtacggtcgggtacctagtacgtaacggtacgacggcgtagaggttagacgtacggagggtaacgtacgtaccttccgacctacctaccaaccgactacccgaaccgtacgccgttaacgccgtaaccgtcttagtaccgtttacgtttaacctttaccgaaccttaacctttacgtaccttaccggaaaccctaagtacggtttcgtacggttacttaccctttccggtacccgtttacccgggttaccgggtaaccccgggttaaacggacggttaaacggtaggttaacccttaacggtaaacccgtaaacggttaggttccgggtacgacccggttacccgaaccgtttaaccgtacgtttaccgtttacgttacccttaaccccgttcccgtttacccgttcccccggttaac

SEQ ID NO: 19216 - DNA, 597 bp, Homo sapiens
  misc_feature: GYAE6OF01ET18R.35.10.A10.1.454.CMB.1.raw
  modified_base (146)..(146): a, c, t, g, unknown or other
  misc_feature (146)..(146): n is a, c, g, or t
  modified_base (260)..(260): a, c, t, g, unknown or other
  misc_feature (260)..(260): n is a, c, g, or t
  modified_base (346)..(346): a, c, t, g, unknown or other
  misc_feature (346)..(346): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
tcagtacagatcgtcacgaccggtgctcgatttagcgtcgatctcagggggagtcagacccagtcaggacacagcatggacatgaggggtccccgctcagctccgtggggctcctgctgctcgtggctcccaggtgaccaaatgtnacatccagctacgacccagtcctccctccaccctgtctgctatcgtggtaaggaagaacgccgtcaacatcactcgccgacagtacagtagtattagtatggtcgctgtatganacgaacgaaacgaacgggaacctacctaatcctagtacttagttaacggtcgttacttaagttaggacggacgggtcggtacctanacgtaggtcgaggcgcaggtcggatcggagtacacgtactcactcaccanctaccgacagcnaccgtanctagattatctttcgaacctaacgttctaacgtcaccgtaagtagttaccttgggtactacgttccgtacctccggttaccgccggtaggtaaactaagtacgtactactaaacgtactagttacgccgttactcgaccttaaccgtatccgttntaaccttntacccgttccacccggtac

SEQ ID NO: 19217 - DNA, 545 bp, Homo sapiens
  misc_feature: GYAE6OF02JB5CB.35.10.A10.1.454.CMB.1.raw
tcagtacagatcgtcacgaccggtgctcgatttagcgtcgatctcgaaggggggacgtaccagaccccagtcgaggacaccagcatggacatgagggtccccgctcagctcctggggctcctgcttgctctggctcccaggtgaccaatcgtgaccatccagctgacccagtctccctccaccctgtctgcatctgtaggagaagcgtcaccgatccacttgaccggaccagtcagagttatagtaattggttgcctggtatcagcagaaccagggaacgccccgtaaactcctgatctttaaggcttctactttagagagtgggtccagtcaaggttcagtcggcagtggatctgggacagacttcactctcaccatcaccagcctgcacgcctgatcgtattttcgacaaccttagttacctgaccaactacgtagtcggtagacttccgtctacgtttccgccctgggaccaaggtcgaatatacgaacgtacgtggtcggtactcgcacctagtctcggttccttcacttcctccgtaccc

SEQ ID NO: 19218 - DNA, 636 bp, Homo sapiens
  misc_feature: GYAE6OF02HC7CK.35.10.A10.1.454.CMB.1.raw
  modified_base (269)..(269): a, c, t, g, unknown or other
  misc_feature (269)..(269): n is a, c, g, or t
tcagtacagatcgtcacgaccggtgctcgatttagcgtcgatctcagggggagtcgagacccagtcaggacacagccatggacatgagggtccccgctcagctcctggggctcctgctggctctggctcccaggtgccaaatgtgacatccagctgacccagtctccctccaccctgtctgcatctgtaggagaagcgtcacctatcacttgccggaccagtcagagtattagtaattggttgcctggtatcagcacgaaaccaggaancccctaaatcctgatcttaaggcgtcgtacttagagagtgggtcccagtcaaggttcagcggcagtgatctggacagacttcactctcaccatcacagcctgcagcctagatgtattttgactaaaccttattaacctcgtaccctaaacgtacgttacgttcgggttacgtacgtttacccggttacgttaaccgttttaccgggtaccccgtttacggggtaaccctaaaacgggttcgggtaaacgttacgttaccgtaaaccggtaaccgttacggtacgggtccttacggtaccctaacccgtaacgttcccgttaccggttaccctttaccgtaaccgtttcccgtttacccccggtaccc

SEQ ID NO: 19219 - DNA, 623 bp, Homo sapiens
  misc_feature: GYAE6OF02H9QJU.35.10.A10.1.454.CMB.1.raw
  modified_base (195)..(195): a, c, t, g, unknown or other
  misc_feature (195)..(195): n is a, c, g, or t
tcagtacagatcgtcacgaccggtgctcgatttagcgtcgatctcagggggagtcagacccagtcaggacacagcatggacatgagggtccccgctcagcgtcttggggctcctgctgctctggctcccaggtgccaaatgtgacatccagctgacccagtcctccctccaccctgtcctgccatctgtacgganaaacgcgtcaccatcacttgccggacagtcagagtattagtaattggttgcctggtatcagtcagaaaccaggaaagaccctaaactctgatctttaaggccgtctaacttagagtagtcgggtcccatcgaaggttcagcggcagtggatcgtgggacagacttcactctacaccatccacacgcctgcacgcctgactagtatttacgactaaccgttattacgtacgtaccaaagtacgttaagtgggtacgtacgttttacccggtaccttaccgttttccgggacccgttacggggtaaacccttaaaggttcggtaacttaacgtaccgtaaaccggtaacggttcggtaacgggtacctacggaccctaaccgtacgttacgttcggtacctttacgtaactttcccttaccccgtaaccg

SEQ ID NO: 19220 - DNA, 513 bp, Homo sapiens
  misc_feature: GYAE6OF02GMFOF.35.10.A10.1.454.CMB.1.raw
  modified_base (368)..(368): a, c, t, g, unknown or other
  misc_feature (368)..(368): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcagaaaccagggaaagcccctaaactcctgatctttaaggcgtctactttagagagtgggtcccatcaaggttcagcggcagtggatctgggacagacttcactctcaccatcaccngcctgcacgcctgatgtattttgctaacctattactgaccaactagtatggtgtacttccgtctactttccggcccttcgggacctaaaggtggaatatacaacgactggtggctgcaccatctgtcttcacttccttcccgtcc

SEQ ID NO: 19221 - DNA, 595 bp, Homo sapiens
  misc_feature: GYAE6OF02H57FO.35.10.A10.1.454.CMB.1.raw
  modified_base (192)..(192): a, c, t, g, unknown or other
  misc_feature (192)..(192): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgaccaaatgtgacatccagctgacccagtcctccctccaccctgtctgcatctgtagganaaagctcaccatcacttgccggacagtcagagtatagtaattggtgctggtancagcagaaacagggaaancccctaaatcctgatctttaaggctactattagagagngggtcccatcaaggttcagcgntagngatctgggacagacttcactctnaccatcaaccgagccttcgcacgccncgatgtagtttagtactaacctaacttaacttacgtaccaaccaacgtaataggtagtaagttaccggttccttaccgtttaccggttcccgttaccgggtaacccgtaaaccggtaacggtaagtaagttaactaaacgaaaccgtaacggtaaggtacgtcggtaccgacctaacgtacttacggttctttacctacttaccttacccgttaccccg

SEQ ID NO: 19222 - DNA, 748 bp, Homo sapiens
  misc_feature: GYAE6OF02JDMWG.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtacggagaaacgcgtacgaccacgtcactttcggcccgggacccaaggtccaaaggtaagttaagttaacgttaaggtttcgggttcggtccggtaggttacttacgacgacgaaaccgaaaaccggaaacgggaaacccgtacccgtaaacctacccgtcggtaacttactttaacggtaacgtaccgttactttaacggttaacgacgtacgggttaccgggtaccgtactaacggttaacggacgttttttacggcgacgtaggtagtacgttcgggtacggacgtacgttacggtacctacctcctacctaacctacgtaaccgacgtaccgtcgtaccgacgaccgtacgtagtacgttagtttgttacgtaaccttaacttaacttacgtacctaacgtaaacgtacgtaacgtagttaacgttacgttaccgttacgttaccggtacccgtaacgggtaaccgtaaacggtacggtaacgtaacgtaacgtaacgtaacgtaggtcgtacgtacgactacctacgtcgttacgttcttcgtacttaccgtcctaccg

SEQ ID NO: 19223 - DNA, 533 bp, Homo sapiens
  misc_feature: GYAE6OF02HL5NM.35.10.A10.1.454.CMB.1.raw
  modified_base (423)..(423): a, c, t, g, unknown or other
  misc_feature (423)..(423): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaaactcctgatctttaaggcgtctactttagagagtgggtcccatcaagttcagcggcagtggatctgggacagacttcactctcaccatccaccagcctgcagcctgatgtattttgactaacctattactagccaactagtatggtnacttccgtactaccgtttccggcccgttagggaacctaaaggtggaatagtacaaacgtactaggtcggactgaccacctagttcctgttccttcacttccttcccgacc

SEQ ID NO: 19224 - DNA, 589 bp, Homo sapiens
  misc_feature: GYAE6OF02H8ICJ.35.10.A10.1.454.CMB.1.raw
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcaccatcacttgccggacagtcagagtattagtaattggttggcctggtatcagcagaaaccagggaaacgcccctaaactcctagatctttaaggcttactactttagagagtgggtcccatcaaggttcagcggcagtggatcgtgggacagacttcacttcacaccatccacacgcctgcacgcctgactgtatttcgactaactnttactgaccaanagttatggtactactttcccgtactaccgtttccgggacccttaggggaaccctaaaggtcggaacttacgtaaccgtaaaacggtacgttagggtacggtaccttggaaccctaaccgtagttaccgttcggttaccttttacctacgttttccccgttcccccggtaacc

SEQ ID NO: 19225 - DNA, 502 bp, Homo sapiens
  misc_feature: GYAE6OF02GMI0R.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagccccctaaaactcctgatctttaaggcgtctactttagagagtggggtcccatcaaggttcagcggcagtggatctggggacagacttcactctcaccatccaccagcctgcagcctgatgattttgactaacctattactgccaacagtatggtgtattccgtctacgtttcgccctgggaccaaagtggatatacaacgactgtggctgcacatctgtcttcatctccgtcc

SEQ ID NO: 19226 - DNA, 546 bp, Homo sapiens
  misc_feature: GYAE6OF02IAQB3.35.10.A10.1.454.CMB.1.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcaagaaaccagggaaagacccctaaatcctgatctttaaggctctactttagagagtggggtcccatcaaggttcagcggcaggtggatcgtgggacagtacttcactctcaccatcaccagcctgcagcctgatgtatttcgactaacctattactgaccaanagtntaggtntattccgtctacgtttcgggccctgggtaacctaaagtggtaatagtacaaacgtaaccgtgtacggcctgccgacctaacgttcgttacgttcctttactactttcccttcccgtaccc

SEQ ID NO: 19227 - DNA, 494 bp, Homo sapiens
  misc_feature: GYAE6OF02HD0O6.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtggggtcccatcaaggttcagcggcagtggatctgggacagacttcactctcaccatcaccagcctgcagcctgatgattttgctaacctattactgccaacagtatggtgattccgtcactttcggcctgggaccaaagtgatatcaacgactgtggctgcaccatctgtcttcattcctccgcc

SEQ ID NO: 19228 - DNA, 583 bp, Homo sapiens
  misc_feature: GYAE6OF02JA7KF.35.10.A10.1.454.CMB.1.raw
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcacatcacttcgccggaccagtcagagtattagtaattggtgcctggtatcagcaagaaaccgagggaactacccctaaattcctagtaactttaagtaacggccttacgttaacgtttaacgaaagggttcggggtaccccaaggacgtaaacgggttccgggcggacgtaggtggacttcgtagggactaggtactttcgactctcacctatcagccaactgacacgctgagtacttgacctaacttacttactacgtacaatagtaataatacttacctactacgttcggacggtaggaaccgtaggtaacgacgaaccaacgactgtacgctacgacacgntacngttctactagtcctccgtacctagtcctagtactacg

SEQ ID NO: 19229 - DNA, 640 bp, Homo sapiens
  misc_feature: GYAE6OF02IMZAK.35.10.A10.1.454.CMB.1.raw
  modified_base (192)..(192): a, c, t, g, unknown or other
  misc_feature (192)..(192): n is a, c, g, or t
  modified_base (254)..(254): a, c, t, g, unknown or other
  misc_feature (254)..(254): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagtacagatcgtcacgaccggtgctcgatttagcgtcgatctcagggggaggtcagacccagtcaggacacagcatggacatgagggtcccgctcagctcctggggctcctgctgctctggctcccaggtgccaaatgtgacatccagctgacccagtcctccctccaccctgtcctgcatctgtagganaaagcgtcaccatcacttgccggacagtcagagtattagtaattggttggcctggtatcgancaagaaaccaggaaagtacccctaaactcctgaactctttaaaggcgttctactttagagtagtcgggtcccatctaaggttcagacggcagtcggatcgtaggganaggtacttcactntacaccaatccacacggcctgcgacnccgttgactgtacgttttanactaaacccttattaaccttgacctaaaccgtagttaacgtgggttagtacgtttacccggtcgttaaccgtttccgggtacccccgttagggggtaaacccctaaaaagggttcgggtaaacttaacttaccgtaaaacgtaaacgttcggtaaaggtcccgttgtaacccgaacctaacgttcttggttaacctttcaacgtttacccttcccgaacc

SEQ ID NO: 19230 - DNA, 536 bp, Homo sapiens
  misc_feature: GYAE6OF02IOBTC.35.10.A10.1.454.CMB.1.raw
  modified_base (371)..(372): a, c, t, g, unknown or other
  misc_feature (371)..(372): n is a, c, g, or t
  modified_base (428)..(428): a, c, t, g, unknown or other
  misc_feature (428)..(428): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcaagaaaccagggaaagcccctaaactcctgatctttaaggcgttactatttagagagtggggtcccatcaaggttcagcggcagtggatcgtgggacagacttcactctcacatcacnncctgcagcctgatgtattttcgactaaccttattactcgaccaactagtatgggtntattcccgtataccgtttccggcccgtagggtaaccaaaggtcgaattacgtacaaacgtaactggtggtctgaccaccagttctgttccttcacttcctcccgtacc

SEQ ID NO: 19231 - DNA, 549 bp, Homo sapiens
  misc_feature: GYAE6OF02I75HQ.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctagatcttaaggcgtctacttagagagtgggtcccatcgaaggttcagcggcagtggatcgtgggacagacttcactctcaccatcaccagcctgcacgcctgatgtattttcgacctaaccttattactcgaccaactagtagtggtgtacttccgtactacgtttccggacccgtacgggaacctaaaggtgaacttacgtaccgaacgtacgtaggtcggactggaccacgtacttctacgttccttctacttcccgttacccacc

SEQ ID NO: 19232 - DNA, 527 bp, Homo sapiens
  misc_feature: GYAE6OF02I2XPE.35.10.A10.1.454.CMB.1.raw
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaaccagggaaacgccccctaaaactcctgatcgtttaaggcgttctactttagagtagtggggtcccatcaaggttcagcggcagtggatcgtgggacagacttcactctcaccatccaccagcctgccagcctgatgattttcgactaaccttnttacttnacccaacagtatggtgacttccgtctacgttttccggcctagggacctaaaggtggaatatacaatactggtcggctgacacngtcttgtccttcncttcctccgtcc

SEQ ID NO: 19233 - DNA, 580 bp, Homo sapiens
  misc_feature: GYAE6OF02IV1E9.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaatcctgatctttaaggcgtctactttagagagtggggtcccatcaaggttcagcggcagtggatcgtgggacagacttcactctcaccatcaccagcctgcagcctgatgtattttgactaacctattactgaccaacagttatggtctagttccgtctacgtttccggcccgttaggggtaaccctaaaggtcggaacttaacgtaccgaaaaccgtaacgttggtacgggtaccgttcggacctaacccgagtttaccgttcggtttacctttaccgtactttacccgttcccccggtaaccc

SEQ ID NO: 19234 - DNA, 505 bp, Homo sapiens
  misc_feature: GYAE6OF02F1GCJ.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagccccctaaaatcctgatctttaaggcgtctactttagagagtggggtcccatcaaggttcagcggcagtggatcgtgggacagacttcactctcaccatcaccagcctgcagcctgatgtattttgctaacctattactgaccaacagtatggtgtacttccgtctacgtttcggccctagggaccaaagtgaatatacaacgactggtgctgcaccatctgtcttcatcctccgac

SEQ ID NO: 19235 - DNA, 611 bp, Homo sapiens
  misc_feature: GYAE6OF02J0E4T.35.10.A10.1.454.CMB.1.raw
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
  modified_base (568)..(568): a, c, t, g, unknown or other
  misc_feature (568)..(568): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagacagagtcaacttatttacttgtccgggcctagtgagagtataagtgttggtggcctggtatcagcagaaaccgagggtaaacgcccctaggactcctagatgtatagggcgtctgttactaacaaaatcggggtacccaacgaaggttcagcggcagtggattcgngggacagtaagttcacgtctccacctatacagtacgccctagccganccgtagattcgtaccgtttnaccttaaaccttatttaacctcgaacctaaactattaaccacgtacttaacgtttacttttcgtaccgttttcgggacgggtaaccggtaacgtaggtacggaaccgttagtacgaaccgtaaggtaaaccttggcggttacnccgtacgaaccttctacgttgtaccctttacgacgttaccccg

SEQ ID NO: 19236 - DNA, 525 bp, Homo sapiens
  misc_feature: GYAE6OF02HAN2V.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtactacttagagagtgggtcccatcaaggttcagcggcagtgatctgggacagacttcactctcaccatcaccagcctgcagcctgatgattttgctaacctattactgacccaacagtatggtgtacttccgtctactttccggcccgttagggaccctaaaggtgaatagtacgaacgtactggtcggctggactaccattctgttccttcgacttccttccccgtacc

SEQ ID NO: 19237 - DNA, 560 bp, Homo sapiens
  misc_feature: GYAE6OF02IXFRN.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagacagcgtcacatcacttgccgggcaagtcagagcattggcagttctttaaattggtatacaaacggaaaccagggaaacgcccctaaactcctgatctatgctgcatcctattttgacgtaaaggtcggggtcccggacgtaaggttcgaggtggcgaggtggatcgtaggacagtattcactctcaccatcagctagtctgacaacgtagaagtatttgacctaacttactattacgtacaacgtagtacgttacaacgtaccgaccgtacgactacacggtccgtacggaccgaacgggacacgacgtagggaactaagttaaacggaacgttggtacgacgtacgaccaacctacttcgtcgttacc

SEQ ID NO: 19238 - DNA, 555 bp, Homo sapiens
  misc_feature: GYAE6OF02IX3QS.35.10.A10.1.454.CMB.1.raw
  modified_base (267)..(267): a, c, t, g, unknown or other
  misc_feature (267)..(267): n is a, c, g, or t
  modified_base (336)..(336): a, c, t, g, unknown or other
  misc_feature (336)..(336): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgctggtatcagcagaaaccagggaaacncccctaaactcctgattctttaaggcttctactttagagtaggtcgggtcccatcaaggttcgagcggnagtggatcgtgggacagacttcactctcacctatcaccagtcctagccaagcctgatgtaattttcgactaacctattactcaccaactagtatggtgtacttccgtactaccgtttccggcccgttacgggacctaaacggtggtaatactaacaacgtaacgttcggtggtactcgtaccactacgtctcgttaccttactaccttcctcccgtacc

SEQ ID NO: 19239 - DNA, 541 bp, Homo sapiens
  misc_feature: GYAE6OF02HGBED.35.10.A10.1.454.CMB.1.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattacttggtcgggccagtgagatataagtgttggttgctggtatnagnaagaaaccgagggaaacgcccctagactcctgatgtagtagggcgtcttgttactaacgaaaagtcgggtacccaacgtaaggttcaggcggcaggtgatcgtagggacagaattcactctcacatcagtacncctgcacgcctgatgtacttcgactaacttnttacgtcgacctaatactacagtctaactttactttctacgtttcggacggacgggtacgaaggtcgactagtacgacgtacgaacgtggtgctagaccacgtactcgttgtcctactcttacccg

SEQ ID NO: 19240 - DNA, 565 bp, Homo sapiens
  misc_feature: GYAE6OF02F52MU.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaacgcccctaaaactcctgatctttaaggcgtctactttagagagtggggtcccatcaaggttcagcggcgagtggatcgtgggacagacttcactctcaccatcaccagcctgcacgcctgatgtattttcgacctaacctacttattcgtacaacagtaagttacacggttaccgcccgacgatacgacgtcgttccgggacctaaacgggaccaaccggaacgtagggaacgtaaagttaaaacggaacgttaggtacggacttagaccacctattccgtcgttaccttctaacccg

SEQ ID NO: 19241 - DNA, 575 bp, Homo sapiens
  misc_feature: GYAE6OF02HH5PK.35.10.A10.1.454.CMB.1.raw
  modified_base (369)..(369): a, c, t, g, unknown or other
  misc_feature (369)..(369): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaatcctgatctttaaggcgttctactttagagtagtcgggtcccatcaaggttcagcggcagtgatctgggacagtacttcactctcacatcacngcctgcagcctgactgtatttgacctaacctatttacgcgaccaaacgtagttactgggtctacgtttcccgtactacccgttttccgggaccccgttaggggaacctaaagggttggaattactaaccgaaacgtacgttggtcggtaccttcggacctaacctagttccttaggttcctttacgactttcccttcccggtaacc

SEQ ID NO: 19242 - DNA, 615 bp, Homo sapiens
  misc_feature: GYAE6OF02HAQD9.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaacgcccctaaactcctgatcttaaggctctactttagagagtgggtccatcgaaggttcagcggcagtggatcgtgggacagacttcactctcacatcaccagcctgcagcctgattgtattttcgacctaaccttattacctcgtaccctaaacgtagttagttcgggttacgtacgtttcccgttaccgttaccgttttcccgggaccccggttacgggtaaacccgtaaagggttcggtaacttaacgtaaccgaaaccggtaacgttcgggtacgggtaccttacggaccctaaccgtacttccgttacgttacctttacgtacctttcccgttaccccgtaccg

SEQ ID NO: 19243 - DNA, 515 bp, Homo sapiens
  misc_feature: GYAE6OF02FLT6Z.35.10.A10.1.454.CMB.1.raw
  modified_base (289)..(289): a, c, t, g, unknown or other
  misc_feature (289)..(289): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctcccctccaccctgtctgcatctgtaggagaaagcgtcaccatcacttgccggaccagtcagagtattagtaattggttggcctggtatcagcagaaaccgaagggaaagaccccctaaaacctcctnatctttaaggcgtctactttagagagtggggtccatcaaggttcagcggcagtggatctgggacagacttcactctcacccatcaccagcctgcagcctgatgacttttgccaacctattactgccaacagtatggtgtattcccgttcactttcggccctagggaccaaagtggatactacaacgtactggtggctcgcaccatcgtgttctcactcttcccgcc

SEQ ID NO: 19244 - DNA, 544 bp, Homo sapiens
  misc_feature: GYAE6OF02IVDTF.35.10.A10.1.454.CMB.1.raw
  modified_base (264)..(264): a, c, t, g, unknown or other
  misc_feature (264)..(264): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtatagtaattggtgctggtatcagcagaaaccagggaacnccctaactcctgatcttaggctctacttagagaggtgggtcccagtcaaggttcagcgcagtggatcgtgggacagacttcactctacaccatcaccagcctgcagcctgatgtatttgactaacctattacgtgaccctaatagttatcggtagtactttccgtacttacgtttccggccgtcgggaaccctaaaggtggtaatactacgtaaacgtacgtaggtcggtcctcgtaccacctagttcttcgttccttacgtaccttccgttccccgtac

SEQ ID NO: 19245 - DNA, 493 bp, Homo sapiens
  misc_feature: GYAE6OF02FTO8I.35.10.A10.1.454.CMB.1.raw
  modified_base (268)..(268): a, c, t, g, unknown or other
  misc_feature (268)..(268): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaancccctaaatcctgatctttaaggctctactttagagagtgggtcccatcaaggttcagcggcagtggatctgggacagacttcactctcaccatcaccagcctgcagcctgatgattttgctaacctattactgaccaacagtatggtgtattccgtctactttcgcctggacctaagtgatatacaacgactgtgctgcacatctgtcttcacttcctccgtcc

SEQ ID NO: 19246 - DNA, 654 bp, Homo sapiens
  misc_feature: GYAE6OF02G59H6.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcaagaaaccgagggaaacgacccctaaactcctagattacgttaaggcttctactttaggagaggtggggtcccatcgaaggttcaggcggcagtggatcgtgggacagtacttcactctcacatcaccagcctgcacgcctgattgtatttcgacctaaccttattactacgaccctaagtagttacgtggttagtacgtttcccgtaccgttacccgttttcccgggacccgttacgggggtaaaccctaaagggttaccggtaaacttaaccgtaaccgtaaaaccggttaaccgttacgggttcgggtaaccttaccggtacccgttaacccgttaacgtttcccgtttacggtttacccgtttaccttaccgtttcccccgtttacccccggtaaccc

SEQ ID NO: 19247 - DNA, 841 bp, Homo sapiens
  misc_feature: GYAE6OF02JZMEX.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccggaccagtcagacgtattagtgacttggttggtctggtatcagcaagaaaccaggaccaaaaaccctactcctagtaatttacgtaacggtccttacgtaagttttaacgaaacggttcgggggtaccccaaggtaccgtaaacggggtttccgggaccgggtacgtaacgggttagggaacgtttcccggtaggggggtaacctagggttaactttttacccgacctttaccgtacctaaccctaagttccgaaaccggacccgtaaacccgttcgggaccgtaacggtccccgttagggtaaaccgggttaccttttacgggtaaacccttaaacttttacgtttaacccgtaccggtaacccttaaaacgtaacggtttaaacttaaaccgttttaaccgggtttaaaccccctttagttttaaacccggttttcggggaaccgggtaaccggggtaaaaccgttaacgggttaaacggaaacccggtaaacccgtaaaaaccggtacgttaccgggttacggtccgtaacggaccccgttaaccgtaacgtttccgttaaccggtttaccgtttacccgtacgtttacccgttccccgtacctacgtttacccgtaaggtaacccg

SEQ ID NO: 19248 - DNA, 899 bp, Homo sapiens
  misc_feature: GYAE6OF02FQJJE.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcacatcacttgccggaccagtcagagtattagtaattggttggcctggtatcagcagaaaccagggaaacgacccctaaactcctagacttacgtttaacggcgttacttaacgtttaggaaggtaggtttcgggggtacccctaagttaccgtaaacgggttttccaacgggtccgggtacgtaagggttacgggtaacgttccggttagggggaacctaacgggtacccttttaccgtaaccttccgttaccctaacccctaacctttaccccgaaccccgtaaccggtaccccgttacggtacccgtaacggtaccccgttacggtaacgtttacggttaacgtttttttaccggaacccgttaaaaccccgtttaacgttttaacccgttaccgtaaccccttaaaaccgttaacggttaacgtttacggggtttacggtttaaccgttttaccccggtttacccgtttaacccggttttttccccggggtaccccggttttaaccgggggtaaaaccccgttaaaaacggggttacgggtaaacgtttaaccgttaaacccggtaaaacccgggttaaccgttaccggggttaacgggttacccgttaacgggtaccccgtaacccgttaccgtttaccgtttaccggttttaccctttacccgttaccgtttcccccgtttaccccggttaaccccg

SEQ ID NO: 19249 - DNA, 620 bp, Homo sapiens
  misc_feature: GYAE6OF02FLSLO.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccgagggaaacgcccctaaaatcctagatctttaaggcgtcttacttagagagtgggtcccatcaaggttcagcggcagtggatcgtgggacagacttcactctcaccatcaccagcctgcagcctagatgattttcgactaaccgtattacctcgaccctaaacgtagtaattgggtagtactttcccgtacttaccgttttccgggacccttacgggggaacccaaaagggttcggtaaacgttaacttaccgaaaaccggtaacgttacgggttacgggtaccttaccgggtacctaacccgtaagttcccgttacggtttaccctttaccgtaactttccccgtttaccccgtacccc

SEQ ID NO: 19250 - DNA, 641 bp, Homo sapiens
  misc_feature: GYAE6OF02J1348.35.10.A10.1.454.CMB.1.raw
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcaagaaaccagggaaacgcccctaaactcctagatacttaaggctctacttagagagtgggtccatcaaggtcagcganagtgatcgtggacagacttcactcncaccatccacagcctgcagcctgatntactttagcctaacgtacttacgtcaccgtaaactagttaagtggttaacgactttccccgttacgttacccgttttacccggggacccccgtttagggggtaaaccccttaaagggttaccgggaactttaaccgttaacccgaaaacccggttaaccgttacgggttccgggtaccgttacggaacccttaaccgtaacgttttccgttaaccggttccttttacccgtaacgttttaccccgttacccccgtacccg

SEQ ID NO: 19251 - DNA, 542 bp, Homo sapiens
  misc_feature: GYAE6OF02HKNFW.35.10.A10.1.454.CMB.1.raw
  modified_base (368)..(368): a, c, t, g, unknown or other
  misc_feature (368)..(368): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggacagtcagagtattagtaattggttggcctggtatcagcagaaaccagggaagcccctaaactcctgatcttaaggcttctactttagagtaggtcgggtccagtcgaaggttcaggcggcagtggatcgtgggacagtacttcactctacaccntaccaccagcctgccacgcctgatgtattttgacctaaaccttattactcgtaccaacgtagtagtggtatacttccgtactaccgtttccggcccgtaggtaaccaaggtgaatacgtacaacgtacgtggtggctgccacgtattcgtcgttccttctacttcctcccgtac

SEQ ID NO: 19252 - DNA, 599 bp, Homo sapiens
  misc_feature: GYAE6OF02I6842.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttcgccggacagtcagagcattggctagttactttaaattggtatacgaacggaaaccagggaacgaccctaaactcctagatctatgctagcatcctatttcgactaaggtcggggtaccgataaggttcaggtggacgtagtacggatcgtaggacagatcgactcacacatcagcagttcacgactaacgtgtaagtactttcgacctaacctacttagttacgtactaaacgtagtaacgttaccgtaacggttacccgaccgtacggtactaccgtacgtaccgttaccggaaccgtaacgggaccaaccgtacgtaggtaacgtaaagttaaaacggagttcggtacgtacgtacggtaccaaccgtactccgttagtccttaaccg

SEQ ID NO: 19253 - DNA, 578 bp, Homo sapiens
  misc_feature: GYAE6OF02JJZEZ.35.10.A10.1.454.CMB.1.raw
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (551)..(551): a, c, t, g, unknown or other
  misc_feature (551)..(551): n is a, c, g, or t
  modified_base (566)..(566): a, c, t, g, unknown or other
  misc_feature (566)..(566): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagacagaaaaccgaggaaacgacccctaaaactcctagattacttaaggcgtactactttagagagtgggtcccagtcaaggttcagcggctagtgtatcgtagggacagtacttacactctacaccatccacagcctagctacgctagactgtactttgactaactattacncgacaactagtatggntacttccgtactacgtttccggccgtaggaacctaagtcggtaataactaccgtaaacgacgttacggtacggtctacgacccgtaacttacgttccgttcggtacctttanacccggttttacccncccgttaacccg

SEQ ID NO: 19254 - DNA, 640 bp, Homo sapiens
  misc_feature: GYAE6OF02F1NR8.35.10.A10.1.454.CMB.1.raw
  modified_base (266)..(266): a, c, t, g, unknown or other
  misc_feature (266)..(266): n is a, c, g, or t
  modified_base (407)..(407): a, c, t, g, unknown or other
  misc_feature (407)..(407): n is a, c, g, or t
tcagtacagatcgtcacgaccggtgctcgatttagcgtcgatctcgaggggggagtcagacccagtcaggacacagcatggacatgagggtccccgctcagctcctgggctcctgctgctctggctcccaggtgccaaatgtgacatccagctgacccagtctccctccaccctgtctgcatctgtagagaaagcgtcacatcactgccggacagtcagagtatagtaattggttgcctggtatcacgcagaaaccgagggaaacncccctaaactcctagacttcgtttaaggcgttctacgtttagagtaggtcgggtcccatcgaaggttcaggcggcagttggttctggggactagtattttcacttctactactatcagtcagtctgaccaacctgaaagtnttgttacacttaaacttacgtacttagtaccaaacgtacgtaacttaccgaccgggtcccctaatttccgtaccgttttcccgggaccccttacgggaacccctacgaacggttaccgaaaaccgttcccaagggtacccgtaacgttcggttacgggaccttacgggtacccaaccttagttcccgttacgtttaccgtttaccctaacgtttcccccttaccccgtaaccg

SEQ ID NO: 19255 - DNA, 651 bp, Homo sapiens
  misc_feature: GYAE6OF02H5E0C.35.10.A10.1.454.CMB.1.raw
  modified_base (305)..(305): a, c, t, g, unknown or other
  misc_feature (305)..(305): n is a, c, g, or t
  modified_base (404)..(404): a, c, t, g, unknown or other
  misc_feature (404)..(404): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctccaggtgccaaatgtgacatccagctgacccagtcctccctccaccctgtcctgcatctgtaggagaaagcgtcaccatcacttgccgacagtcagagtattagtaattggtgcctggtatcagcaagaaaccgaggaaacgcccctaaagtcctagatctttaaggcttactacttagngtagtgggtaccatacgtaaggttcaagcggactagtaggactcgtagggactaggacttcactctacaccgataccacacgacctgccagcctagatntatttcgaactaaccgttattacgagtacccaaagtaacgttagtcggtagtacgtttacccggtctaaccgttttccgggacccgttacggggaaaccctaaaacgggttggtaaaaccgtaatttaacccgaaaaaccggtaacggtttcgtacgggttaacctacgggaccctttaaaaccgcctttacggtttccggtttaccttaacccgggtaactttcccccggtttaccccgtaacccg

SEQ ID NO: 19256 - DNA, 679 bp, Homo sapiens
  misc_feature: GYAE6OF02JZ9RL.35.10.A10.1.454.CMB.1.raw
  modified_base (507)..(507): a, c, t, g, unknown or other
  misc_feature (507)..(507): n is a, c, g, or t
  modified_base (656)..(656): a, c, t, g, unknown or other
  misc_feature (656)..(656): n is a, c, g, or t
tcagtacagatcgtcacgaccggtgctcgatttagcgtcgatctcaggggagtcgagacccagtcaggacacagcatggacatgagggtcccgctcacgctcctggggctcctgctgctctgctccaggtgccaatgtgacatccagctacgacccagtcctccctccaccctgtctgctactcttgtacggagaaacgtcgtacaccatcacttcgccggtacacgtacgagaacgttattaggtaagttgggttcgtccgtaggtactcgagtcaacgaaacgacgggtaaacgaccccgtaaactccgtacgtaacttacgttaacggtccttacgttactttaacggtagtacggttacggggtaccctagtacgtaacgggttactacggcggtacgtaacggtaggtacgtcgtaggggacgtaacggtacttaccgtacgtactacctaaccgaactccgaacctaccgaccttacgaccacggtacctgacttacggtntttacgacctacctattacctgtaccaattatacgtgtacgttacttcgtactaccgtttccgaccgtttaggaacctaacggtagaacgtaacactaacgacgttaggcggtacttcggaactaccgtattaccgttctaccgtttanaccctttacgttcccccgtaacg

SEQ ID NO: 19257 - DNA, 773 bp, Homo sapiens
  misc_feature: GYAE6OF02JHC5J.35.10.A10.1.454.CMB.1.raw
tcagtacagatcgtcacgaccggtgctcgatttagcgtcgatctcaggggagtcagacccagtcaggacacagcatggacatgagggtccccgctcagctcctggggctcctgctgctctggctcccaggtgccaaatgtgacatccagctgacccagtctccctccaccctgtcctgcatctgtaggagaaagcgtcaccatcacttgccggaccagtcagacgtattagtaattggtggccttggtactcagctagaaaccgtagggaaacgtaccccgtaaactccgtagaattacgtttaaggccgttacgtactttaggacgtaaggtcggggtaccctaagtaccgtaagggttcacggtcggtactaggtaggtaagtcgttagggactaggtaccttcgtaacgttaccttaccaacccgtattacccgaaccctacggtaccgttcgacctacgaccccgtttgaactttcgggttaaactttttccggaaccttaaacccgtttacgttaccgtaacggtacccgtaaacgttaacggttacgttaacgggttaccgttaaccgttttaccccgggtacctttaaccgggtttttaccccgacccgggtttaacggggaaacccgtttaaaacgggtcgttaaacgttaaccgtaaacccgttaaacggtacggtttacgggttaccgggtacttacgggtaccctaaaccgtttacgtcccggtttagttccctttacgtactttccccgttaccccgtacg

SEQ ID NO: 19258 - DNA, 603 bp, Homo sapiens
  misc_feature: GYAE6OF02HCJIF.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtcaccatcacttgccggacagtcagagcagttggctagtttactttaaagttggtatacgaaacggaaaccgagggaaacgacccctaaactccgtagactctatgctgctactcctatttcgacgtaacggtcggggtacccggtagtaacggttcgaggtggacgtaggtgagtcgtgggacagtaattcactctacacatcgagcgtagtctacgacaacgtgtaagttactttacgactaacttattacgttacgtacaactagtacgttaaccacggtacccgacccggtcgacttaccgtagtccgttaccgggaccaaacgggtaccacggtacgtaggaacgtaaacgttaaacgtacgtggtacgtcgtacgacctacgtacgtcgttcgtcttaccg

SEQ ID NO: 19259 - DNA, 710 bp, Homo sapiens
  misc_feature: GYAE6OF02FYMTO.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaagcgtccacatcacttgccggaccagtcagtagttattaagtagttggttggcctggtatcgagacgaacgaaaccgaagggaaaccgtacccccttaaactccgttagacgtttacgtttaacgggccgttacttaacgtttagaggtacgggttcggggttacccctaattacgtaacggtttcgacggtcgggacgtaggttaggacgtcgtaggggactacgtaccttcgtaccttacctaccaaccctactaccaacccgacgtaccctcgtaccgtacgtcgtcgtacgttagtacgttttacgaccttaaccttacgttaccgtacgtaccgtaaacgtagtacgttaggttacgtaccgtttcccgttacgttaccggtttccggtacccgtacgggtaaccgtaaggtacgtaactacgtaaccaacgtacgtaggtccgtagttaccgaccgtaccgttagtttccgttccgtttacctttacctacgttttccccgtaccccgtacc

SEQ ID NO: 19260 - DNA, 555 bp, Homo sapiens
  misc_feature: GYAE6OF02HHCVJ.35.10.A10.1.454.CMB.1.raw
  modified_base (189)..(189): a, c, t, g, unknown or other
  misc_feature (189)..(189): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctcaccctgtctgcatctgtagganaaagcgtcaccatcacttgccggaccagtcagagtattagtaattggttggcctggtatcagcagaaaccagggaaacgcccctaaactcctagattctttaaggcgtctactttagagtagtgggtcccatcaaggttcagcgcagtggatctgggacagacttcgactcgtcacctatcaccgagcctgcacgcctgatgtattttcgacctaacctacttacgtcgaccaactagtatggtgacttccgtactacgtttcggaccgtcgggtaacctaaagtacggtactacgtacgaacgtacgtggtcggtacgtacgctaccgtatcgttacgtccttacgtacttccgtcccgtacccg

SEQ ID NO: 19261 - DNA, 550 bp, Homo sapiens
  misc_feature: GYAE6OF02F8DYW.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggtggcctggtatcagcaagaaaccagggaaacgcccctaaaatcctgatctttaaggcgtctacttagagagtgggtccatcaaggttcaggcgcagtggatcgtgggacagacgttcactctacaccatcaccagcctgcagcctgatgtattttcgactaaccttattactcgaccaacgtagtactggtacgtattcccgtattaccgtttccggcccgttagggaacccaaaggtcgatactaccaacgtactggtggacttcggacctacctagttcgtcgttccttactacttacccttcccgtaccg

SEQ ID NO: 19262 - DNA, 623 bp, Homo sapiens
  misc_feature: GYAE6OF02GXAM9.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtagagaaagcgtcaccatcacttgccggaccagtcagagtattagtaattggttgcctggtatcagcaagaaaccagggaaacgcccctaaactcctagtattcgtttaaggcttctactttagagtaggttgggtccagtcaaggttcaggcggcaggtggatcgtgggacagtacttcgactctcaccgatcaccagcctgcacgtcctaggattgtagttttcgactaacccttattaactacgaccctaaagtacggtattcggttagtacgtttccgtactttaccggtttccggtcccgttacggggaaacctaaaggttacggtaacttacgttaaccgaaccggttaacgttcgggttacgtaccggttacgtaccgtaaccgttagttccgttacgttccttaccgttacgtttcccttaccccggtacc

SEQ ID NO: 19263 - DNA, 573 bp, Homo sapiens
  misc_feature: GYAE6OF02JAHJV.35.10.A10.1.454.CMB.1.raw
  modified_base (188)..(188): a, c, t, g, unknown or other
  misc_feature (188)..(188): n is a, c, g, or t
  modified_base (304)..(304): a, c, t, g, unknown or other
  misc_feature (304)..(304): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctccaggtgccaatgtgacatccagctgacccagtctccctccaccctgtctgcatctgtagganaaagcgtcaccatccattcgccggaccagtcagagtattagtaattggtgcctggtatcagcagaaaccagggaacacccgtaaactccgtgtactcgttaagcgttctacttagngagtcgggtccagtcaggtcagcggcagtgatcgtggactagactcactctacactactcaccaggcctgcgagcctgtatgtatttcgactaacctagttacctgaccaacgtagtacttgggtactacgttccgtaccttacgtttccggtaccgtcgggtaacctaagggtacggtactaacgtaccgaacgtacggtgtacgggtcctaggtacccctaccgtaattccgttcttacccgttacctacgttcccttacccggacc

SEQ ID NO: 19264 - DNA, 607 bp, Homo sapiens
  misc_feature: GYAE6OF02INJGY.35.10.A10.1.454.CMB.1.raw
tcagtacagatcgtcacgaccggtgctcgatttagcgtcgatctcgggggggagtcagacccagtcaggacacagcatggacatgagggtccccgctcagctcctggggctcctgctgctctggctcccaggtgccaaatgtgacatccagctgacccagtctccctccacctgtctgcatctgtaggagaaagcgtcaccatcacttcgccgaccagtcagagtattagtaattggttgcctggtatcagcaagaaaccgagggaaacacccctaaactcctagacttacgttaaggcttacttacgttagaggaggtcgggtcccagtacgaaggttcaggcggcgtaggtggagtcgtaggacagtacttcactctacaccactaccaccacgccgtcgaccacgtaccctgtaattggttaattttacgaccttaaacctttaacttacgtacgaaccctaaagtagttattacgggtacgtacctttccggtaccttaccggtttccggacccgttagggaacctaaggtgactaacgtacgaaacgtactggtacgctcgactactatcgttctccgttactaccgttccctacccgctac

SEQ ID NO: 19265 - DNA, 621 bp, Homo sapiens
  misc_feature: GYAE6OF02GS6T6.35.10.A10.1.454.CMB.1.raw
  modified_base (268)..(268): a, c, t, g, unknown or other
  misc_feature (268)..(268): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcagaaaccagggaaacncccctaaactcctgattacttaaggcgttctactttaggagtagtcgggtcccatcgtaaggttcaggcggcagtggatcgtgggacagtacttcactctcaccatccaccngcctgacngctgatgtatttcgacctaaccttattactcgaccaactagttagtggtacgtacgttcccgttacgttaccgttttccgggacccgttacggggtaaaccctaaaggttcggtaaacttaacgtaaccgtaaacggtaacgttgggttacggtccgttacggtacccgtaacccgttaagttcccgttaggttaccctttaccgtaccttttccccgttccccggtaacccg

SEQ ID NO: 19266 - DNA, 738 bp, Homo sapiens
  misc_feature: GYAE6OF02HWVAY.35.10.A10.1.454.CMB.1.raw
tcagtacagatcgtcacgaccggtgctcgatttagcgtcgatctcagggggaggtcagacccagtcaggacacagcatggtacatgagggtcccgctcagctcctggggctcctgctgctctggcctccgaggtcgaccaaatgtgactattccagctcgaccctagtcctccctcctacctgtctgcatctgtaggagaagcgtcaccatcacttcggaccggaccgtagtcgaagtacgttattacgtaagtttgggtcgccgttggtatcacgacgtaacgtaaaccgaagggtaaaccgaccccttaaacgtcccgtagtaactttacggtttaaacggccggtttacgttaactttacggggaacggtaacggggtccgggggttaccctaggttaccgtaaaacgggtttccgaagggtccgggtactaaggggttacggtacggttacggttaacgggggaacctaggtaaccctttacgaaccttccgtaaccctaccacttacccgaacctaccggtccgtacggacgtacgtccgtagtacttagtacttttcgaacctaaccttactacctacgtaccaacgttacgtacgtgttactacgttccgtacttaccgttaccgggtaccgtaggtaaccgtaaggtagagtaacgtacgtaaccgtacgtacggtcggtcgtacgacctaccgtatccgtagttccgttacgtaccttccttcccgtac

SEQ ID NO: 19267 - DNA, 686 bp, Homo sapiens
  misc_feature: GYAE6OF02ITIPK.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcacatcacttcgccgaccagtcagtagtattagtaattggttggcctggtatacagacagaaaccgagggaaacacccctaaactccgtagattcgttaaggcgttactacttaggaggaggtcggggtacccatccgaaggttcacggcggtacaggtcggatcgtagggactagtaacttccgacttcactacctacgtacaccctacgtcctcgaccacgccgtacggtattcggttaactttcgaaccgttaacccttagtttaacgttaccgtacccgtaaacgtagttaacgttcggttacggtaacgtttcccgttacgtttaccgtttacccgggacccggttaccgggtaaacccgttaagggttacggtaaaccttaacgtacgtaaaccggtaacgtttagggtacggtacgttacggtaccctaacgttacgttacgttacggttccctttacggtaaccctttcctacccggttacc

SEQ ID NO: 19268 - DNA, 800 bp, Homo sapiens
  misc_feature: GYAE6OF02HCRJY.35.10.A10.1.454.CMB.1.raw
  modified_base (276)..(276): a, c, t, g, unknown or other
  misc_feature (276)..(276): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctcccctccaccctgtctgcatctgtaggagaaagcgtcaccatcacttgaccggaccagtcagtagtattagtaattgggttgccttggtatcagcaagaaaccgagggaaacnccccctaaactcctagaacttcgtttaaaggccgttacttaacgtttaggagtacgggttacggggtccctagttacgaaaggttcgaggacgggactaggttaggagttccggtagggtaaccacgtacgttaccgactttccgtaccaacctacgtccaacccgtagtccctcgccgacgtccctagtacgtttaggttacgtttttaccgaaccttaaacccttacgtttaaccgtccgaaacccgttaaaccgtaggtttaacgttacggggttaacgttaacccttttccccgggttaccctttaacccgggttttttccccggggacccccggtttaacggggtaaaccccggttaaagggttacggtaaacgtttaaccttaacccgggtaaaaccggtaccgtttagggttccgggtaccggtttaacgtaaccccgtaaacccgtttactttacccggtttacggttttaccctttacccgtttaaccgttttcccccgttaacccccccggtac

SEQ ID NO: 19269 - DNA, 589 bp, Homo sapiens
  misc_feature: GYAE6OF02IMKYL.35.10.A10.1.454.CMB.1.raw
  modified_base (269)..(269): a, c, t, g, unknown or other
  misc_feature (269)..(269): n is a, c, g, or t
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (549)..(549): a, c, t, g, unknown or other
  misc_feature (549)..(549): n is a, c, g, or t
tcagtacagatcgtcacgaccggtgctcgatttagcgtcgatctcaggggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggtgcctggtatcagcaagaaaccagggaaacnccccgtaaaactcctagattctttaaggcgttctacttagagaggtgggtccatcaagttcagcgnagtgatcgtgggacagtacttcacgtcncaccatcacacgcctgcagcctgatgtatttcgactaaaccttattacgtacgtaccaacgtagttaagtggtatacgttccgtacttaccgttttcggcccgttagggaacctaaaggtcgaattaacgtacgtaaaccgaacgttggtcggtacctacggtaccctaaccgtaattcccggttnttacccgtttacctaactttccccggttccccgtaacccg

SEQ ID NO: 19270 - DNA, 752 bp, Homo sapiens
  misc_feature: GYAE6OF02IYK1R.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctactctggctccgaggtgccagatgtgacattcagatcgacccagtctccatcctccctgtctgcatctgtaggagacagagtcaccgtcacttcggccgggacaagtcagagactaattaacaagtaaatttaaattggtaatcagacaagaaaccgtaggaaacgtcccgtaggcctcctcactctatgctcgtcctttacctactttcgaacgtaacggtaggttccgggggttaccaagttaccggtaaacggttcgaaggacggtactacgttaggactcggtagggaactaggtaaactttcggaccttcgtaccaacccgtagttaccgaacgtaccgtacgttaccgtacgtaaccgtaaacccggttaggttaaaacgttttacgttttaaccgaaccgtttaaaaccctttaaccgtttaaaccgttacgttaaaccaaaccgtttaaaggtaaccgttttaacgaacggttcggttacctttaccgttaacccgggttttccgggaacggggtaaaccgggtaccggtaacgggttacgaaacgttaacccggtaacgtaaaaccgggtaagttaccgggttacggaccgttacgaccgttaaccgtcgtttaccgttacgttacc

SEQ ID NO: 19271 - DNA, 606 bp, Homo sapiens
  misc_feature: GYAE6OF02HZ1TS.35.10.A10.1.454.CMB.1.raw
  modified_base (356)..(356): a, c, t, g, unknown or other
  misc_feature (356)..(356): n is a, c, g, or t
  modified_base (454)..(454): a, c, t, g, unknown or other
  misc_feature (454)..(454): n is a, c, g, or t
tcagtacagatcgtcacgaccggtgctcgatttagcgtcgatctcagggggagtcgagacccagtcaggacacagcatggacatgagggtccccgctcagctcctgggctcctgctgctctggctcccaggtgccaaagtgtgacatccgagctgaacccagtacctccctccacctgtctgcatctggtaggagaagcgtacaccatcactgccgacagtcagagtagttagtagttggtagcctgtatcagcaagaaccagggaaaccacccctaaatcctagattcgttaaggccgttacgtacgttagagtacggtgggtacccagtacaaggttcaggtcggagaggtggntcgtagggactagtaccttcgactctaccacagtaccacgactcgtgaccctagccgttagacgttagttacgtttcgaaccttaaccttacgttacnccgtaactacgtaacgttagtggtacgttacgtttccgtaacttccgtttccggacccgttaggtaaacccgtaagtggaaacttacgtaacgacgtaacgtggttacggcttacgcgtactgtcgttcgtctcctacgttcccgtccgtac

SEQ ID NO: 19272 - DNA, 641 bp, Homo sapiens
  misc_feature: GYAE6OF02GKURV.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctggtaggagaaagcgtcaccatcacttcgccggaccagtcagagtattagtaagttggttgcctggtatcagcaacgaaaccgagggaaacacccctaaactcctagattcgttaaggcgttacttacgtttagaggtaggtcgggtacccagtacgtaaggttcaggcggcgtaggtggatcgtagggactagtacttcactctaccacctataccacacgcctgcacgtctgtactgttactttacgaaccttaacttacgttaacctcgtaaccaaacgttaggttagtggttacgtaccgtttcccgtaccgttaccggttttcccggacccgttacggggaaacccttaaaggtcgtaaacttaacgtaaccgaaccgttaaccgttgggacggtcctaccggacctaaccgtattccgttacggttccttacgtaccttccccgtaccgtacc

SEQ ID NO: 19273 - DNA, 541 bp, Homo sapiens
  misc_feature: GYAE6OF02HIDC9.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctacttagagagtggggtcccatcaaggttcagcggcaggtggatctgggacagacttcactctcaccatcaccagcctgcgagcctgatgtattttgctaacctattacttgaccaacagtatggtgtattcccgttctaccgtttcggtccgtcgggaccgtaaacgtaggtactaagtaccaacggacctaggtcggacgttgccaccattctcgttcctttacacttacccttcccgtaccc

SEQ ID NO: 19274 - DNA, 610 bp, Homo sapiens
  misc_feature: GYAE6OF02FQJMH.35.10.A10.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtagganaaagngtcaccatcacttgccggaccagtcagagtattagtaattggtgctggtatcagcagaaaccagggaaacgcccctaaactcctgattcgtttaaggcgtctactttagagtaggtggggtcccatcgtaaggttcaggcgcgagtggatcgtgggacagacttcgactctcactatcaccagcctgcagcctgacttgagttttcgacctaaaccttagttactacgacccgtaaatacggtaagttcggttagtacgtttcccgtaccttaccgttttccggacccgttacgggaaacctaaaggtcggtaactacgttaaccgaaaaccgtacgtacgggttcggaccgttacgacccgtaacgttacgttacgttcgttaccgtttactacctttcccgttcccctaaccg

SEQ ID NO: 19275 - DNA, 208 bp, Homo sapiens
  misc_feature: GYAE6OF02FKDUS.35.10.A10.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (200)..(208): a, c, t, g, unknown or other
  misc_feature (200)..(208): n is a, c, g, or t
tcagtacagatcgtcacgaccggtgctcgatttagcgtcgatctcgagggggagtcagacccagtcaggacacagcatggacatgagggtccccgctcagctcctggggctcctgctgctctggctcccaggtgccaaatgtgacatccagctgacccagtctccctccaccctgtctgcatctgtaggagancgnactnnnnnnnnn

SEQ ID NO: 19276 - DNA, 699 bp, Homo sapiens
  misc_feature: GYAE6OF02JFYKL.35.10.A10.1.454.CMB.1.raw
  modified_base (661)..(661): a, c, t, g, unknown or other
  misc_feature (661)..(661): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgaccaaatgtgacatccagctgacccagtcctccctccaccctgtctcgcatctgtaggagaagcgtcaccatcacttcgccggaccaggtcagatattagtaagttggttgcttggtatcagcaagaaccgacgggaacacccctaactcctagacttacgtttaaggcgtacttacgttaagacgtaggtacgggtacccaagttacgtaacggttacacggtacggcgtaggtaggtactaccggttagggaactacgggtaccttacgtaccgtccgttaccgaccctaacgttacctaacccgtacggtacccgttcgaccgtaccgttacccgtaggtacttaggttactttttacgaacccgttaacttaactttactaccggtacctaacctaagttacgttggtacgttacgttccgtaccgtttaccgttaccggtccgttaccgggaacgttaaacgtacggtaacttaagaaccgtaacgtaacgttacggtcggacctacggtaccactaccgttnttaccgttacttacccttactccccgttacccgtaccg

SEQ ID NO: 19277 - DNA, 735 bp, Homo sapiens
  misc_feature: GYAE6OF02FP9Y2.35.10.A10.1.454.CMB.1.raw
  modified_base (193)..(193): a, c, t, g, unknown or other
  misc_feature (193)..(193): n is a, c, g, or t
  modified_base (710)..(710): a, c, t, g, unknown or other
  misc_feature (710)..(710): n is a, c, g, or t
  modified_base (722)..(722): a, c, t, g, unknown or other
  misc_feature (722)..(722): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcattctgtagagaancgtcaccatcacttcgccggtaccagtcgagtagttattacgtaagtttggtcggccttgggtactcgaagtaccaacggaaaacccaaggggaaaaccgacccccgttaaaactccccttaggatttaccgtttaaacggtccgttacttaacgttttacgaagggtaacggttcggggtaccctagttaccgtaacgggtttcaacgggccgtacgacggttacggtattaccggtaggaaccgaggtaacgtttaccgaacttacccgacgtaaccctacgtacccgaccaacggtcccttacgacgtacggtcccttaggacttacgtttacgtttccgaacttaccctaactttaccgttacgaccctaagtacgtgtacggtactacgttccgaaccgtttacgttccgggacgttcggaaacctaaagtcgaaacgtttacaacccgaattcggaagttccggaccgttacgacctaaccgtagtttcccgtacggtttacgtttaaccnccggtttacccncccggttaacccg

SEQ ID NO: 19278 - DNA, 516 bp, Homo sapiens
  misc_feature: GYAE6OF02IPA6E.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggtggcctggtatcagcagaaaccagggaaacgcccctaaactcctgatctttaaggcgtctacttagagagtggggtcccatcaaggttcagcggcagtggatcgtgggacagacttcactctcacatcaccagcctgcagcctgatgtatttgcaacctattactcgaccaactagtacgtggtagatttccgtctacgtttccggcctcgggacctaaaggtgtaatataccaacgtactggtggtctcggccacatcttgtcttcattcttctcccg

SEQ ID NO: 19279 - DNA, 761 bp, Homo sapiens
  misc_feature: GYAE6OF02HK863.35.10.A10.1.454.CMB.1.raw
tcagtacagatcgtcacgaccggtgctcgatttagcgtcgatctcagggggagtcagacccagtcaggacacagcattgacatgagggtccccgctcagctcctggggctcctgctgctctggctcccaggtgccaatgtgacatccagctgacccagtcctccctccaccctgtctgcatctggtagagaagcgtcaccatcacttgacccgacagtacagtagtattagtatttggttacggtccgtaggttactcgagtaccgaagaaaccgaaggggaaaccaccccctaaaactcctagacttacgtaactgctacgactacttccttaagttttcggaacgtaacggggttccgggggtacccgtacgtaacggttcgaggttcggacgtaggttaggacttacgggtagggtactaaggtaacttaccaaccttaccgtaccctaaccgtactacgtacgtacgtaggttcctacggacctaaacccgttagaacgtttactttaccggaaccttaaaccgttattacgttacgtaaccaagtaacgtacgttaaccgtacggttaacccgcccgtacgtacgtaccggtaacgttaccggttacccgggaaccgtaaacgggacccgtaacgggtaaccggtttaagggaaacctttaaaacgggtttaaaaacgggtccgtttaacgggtaacggacccgttaccgggtaaccctaacccggtttacgtttaccccgttaggtttacccccg

SEQ ID NO: 19280 - DNA, 788 bp, Homo sapiens
  misc_feature: GYAE6OF02GJYUY.35.10.A10.1.454.CMB.1.raw
  modified_base (273)..(273): a, c, t, g, unknown or other
  misc_feature (273)..(273): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctcgacccagtcctccctcccaccctgtctgctatctggtaggagaaacgcgtcacatcactcgccgacagtcagtatatagtagttcggttgcctggtatcgagcaagaacgacgggaaacnccctagacctcctgataggtagtacgggtctgtcgttactaacgtaaacgttccgggtaccctaacgtacggttacgacggcggtacgtaggtacggattacggtacgggtaacgtaacgtaacgttaccgtaaccgttcctacccgaacctaccggttaccggaaccggttaaccggtcccgttaaccggaccgtaccgggtaccgttaacggtaaccgtcggttttaacccgtttacgaacccgttaaaccctttaaacgtttaccctaaccgggaaccccttaaaaccgtactttaaccgtaccggttacttaacccgttttaacgttttcccgttacgggggttaacccggggtacgggtaacccggggtaacggttaaccgggtacgtaaccggtaccgttacgggaaccgttaacccggtaacggttacgggtaccggtaccgtaccgtaccgtaacccggtttacttacccgtttccggttactttaccccggtacctttacccccgg

SEQ ID NO: 19281 - DNA, 599 bp, Homo sapiens
  misc_feature: GYAE6OF02IDGLC.35.10.A10.1.454.CMB.1.raw
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtcctccctccaccctgtctgcatctgtaggagaaagcgtcaccatcacttgccgacagtcagagtatagtaattggtgctggtatcagcagaaaccagggaaacgacccctaaactcctagatctttaaggcgtacttactttagaggagtggggtcccatcgaagttcaggcggacagtggtancgtgggactagacttcactctccacatcgaacncgcctagacagcctgatgtactttgactaactattacngtaccaacgtagtagtcgggtataacgtttcccgtacgttaccgtttacccgcccggttacgggaacccttaaaagggtcggaaagttaacgtaccaaaacgggtaccttagggtaccggtactacggtacccgtaaccaattcccgtggtttaccctacttccttacccttaccccggaaccc

SEQ ID NO: 19282 - DNA, 656 bp, Homo sapiens
  misc_feature: GYAE6OF02G305P.35.10.A10.1.454.CMB.1.raw
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
tcagtacagatcgtcacgaccggtgctcgatttagcgtcgatctcgagggggagtcagacccagtcaggacacagcatggacatgagggtccccgctcagctccgtggggctcctgctgctctggctccaggtgaccaaatgtgacatccagctcgacccagtcctccctccaccctgtctgcatctagtaggagaaagcgtacaccatcctacttcgaccggaccagtcaggattattagttaagttggtcggtacctaggtatacgagacaaagaaaccgaagggaaacacccctaaaactcctagacttacgtttaacggcgttaccttaacgtttaggaggtacggtcgggtacccataccgtaaggttcaaggccggacgtagtcggatcgtgggaactaggtacttcactntaccacctagtaccaccatccgtnacgacgaccttagagtcgttaattcgactaacttatatcgaccaagttgaacgttggtattaccgttcgtaacgttcgtttacccgggccgtttaacgggaaccttaaagggtcctaaagttaccgtaaaccgtaaacgttaccgtcggtagtaccttacggccttaaaccgtgtttccgtaacttcgttaccacgtttaccccggtcctaaccg

SEQ ID NO: 19283 - DNA, 673 bp, Homo sapiens
  misc_feature: GYAE6OF02GY7Q1.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctcgacccagtcctccctccaccctgtctgcatcgtgtaggagaagcgtcaccatctacttcgcccggacagtcagtagtattagtagttggttcgccttaggtatcgagacaaggaaaccgaagggaaccgtaccccctaaatcctagtaacttacgttaacggcttacttaacgttaggaggtagggtccgggtaccagtacgtaaggttcgaggccggagtaggtggtatcggtagggactagtaccttacacctcctaccacctactccaaccgtacgtccgtcgaccgtacgtcgtacgtagttagttactttacgaaccttaaccttactacctaccgtaaccaagttagtagttcgggtacttacgttaccgttaccgttaccgtttaccggcccgttaagggaaccgttaaaggtacggtaactaacgtaaccgtaaacggtcgttagggccgtcgtaccgaacccttacggttacttcggtacgtttacctaccttaccgttccctccccgtac

SEQ ID NO: 19284 - DNA, 789 bp, Homo sapiens
  misc_feature: GYAE6OF02IUTTS.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggcctccaggtgaccaaatgtgacatccagctcgacccagtcctccctccacctgtctgctatcgtagtaggaagaacggcgtacaccatcgaccgttcgaccggacctagtcagtaagttattagtaagtttcggtcggtccttaggtactacacgaacgaacgaaacgaacgggaaaccgtaccccctaaacgtcgtagtaacgttacgtttaaccggtcgttacttaacgttagggacggtacggttccgggtaccctaagtacgttaaacgggtccgtcggacggtcgacggtgacgttacggacgggacgtactacgttcctaacgtctaacctaccgactacccgacgaccgtccgtacacgtaccgtccgtaggtaacgtttagttaccgtttacgaacccgttaaccttaacgtttacctaccgaaccttaaaccgggttcttacgggtcggttaaccgtttccgttaaccccggtttccgtttaaccccggtttacccgggtacgggttaacccgggtaaaccgttaaacgggtttaagtaaccgttaaacccgttaaccgaaacggtttacgtacgggttaacgttaccggaacccgtactaaccgttaggtttccgtactttacccggtaccctttagttaccccccgttcgtaccg

SEQ ID NO: 19285 - DNA, 680 bp, Homo sapiens
  misc_feature: GYAE6OF02IQKOV.35.10.A10.1.454.CMB.1.raw
  modified_base (128)..(128): a, c, t, g, unknown or other
  misc_feature (128)..(128): n is a, c, g, or t
  modified_base (137)..(137): a, c, t, g, unknown or other
  misc_feature (137)..(137): n is a, c, g, or t
  modified_base (159)..(159): a, c, t, g, unknown or other
  misc_feature (159)..(159): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
tcagtacagatcgtcacgaccggtgctcgatttagcgtcgatctcaggggagtcagacccagtcaggacacagcatggacatgaggtcccgctcagctcctgggctcctgctgctctggctccaggtnaccaaatgngacatccagctgaccctagtcnccctcaccctgtcctgcaatctgagacaagtcgcaccattcgcttgacccgacagtcatgtaatgtaacttggtggcctaggtatcngacagtaaaccaggaagccctaaaacnccttagactntttaacggctactatttagnaagtgggtcccatgaaagttccaaggcggtcaagtacggtattctaggggacaggttacttaanaccgttcncaaacnttaccggaacttacggctggtctaaacggccttgaatcgtttaagtttcgtaacctaaaccctaattacgggttaccgactaaacccgggtactaaacgttgggtagtaaaccggtttcctaacccgttttaccggttaacccgggtccgttttaacccgggaaaccggtttaaaccgtacgggtttaaacgtaacgttaaccgtaaacccggttaagttacggtaacggtaccgttacgacccgtaaccgtaacgttaccgttacgttaccttacccttacgttcccgttaccccgac

SEQ ID NO: 19286 - DNA, 785 bp, Homo sapiens
  misc_feature: GYAE6OF02IVKBZ.35.10.A10.1.454.CMB.1.raw
tcagtacagatcgtcacgaccggtgctcgatttagcgtcgatctcagggggagtcagacccagtcaggacacagcatggacatggagggtccccgctcagctccgtggggcctcctgctgctctggctcccgaggtgaccaaatgtgacatccagctacgacccagtcctcccctcctaccttgtctgctacttcgtagtaggaacgaaatccgtacacctatacctacttcggacccggacctgtaccaggattaagttagtaggttgggttacggccgtaggtactcgacgacgaaccgaaacgaacgggaaaccctacccttaaactccgtagtactttacgttaaggcgttacttaacgttaaggacggtacgggtttaccggggtaccctaaaggttaccggttaaacgggtttccgaacggggtcccggtaaacggttaggttacgggggtaactacggggtaacgggggtaaccgaaccgtttaaccttccggtacctcccgttaaccaaccctacgtacccactacgtacccgtcgaccgtaccgtcgtagtagttgtttacgtttacgaccttaacctacgttactcgaccgtactagtaacgtcggtacgttcgttacccgttacgttacccgtttcccggacccggtaacgggtaacgtaacggttacgtaaactacggttaaccctaacgtacggttacggtggttaacccgttcgtaacaccgtttaccgttcgttacgttccctttaacgtcccgtttcccgaacccgttc

SEQ ID NO: 19287 - DNA, 676 bp, Homo sapiens
  misc_feature: GYAE6OF02FLMSD.35.10.A10.1.454.CMB.1.raw
  modified_base (133)..(133): a, c, t, g, unknown or other
  misc_feature (133)..(133): n is a, c, g, or t
  modified_base (214)..(214): a, c, t, g, unknown or other
  misc_feature (214)..(214): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggctcccaggtnccaaatgtgacatccagctgacccagtctcccctccaccctgtctgcatctgtaggagaagcgtcacatcacttgccgacngtcagtatattagtattggttgccgtggtatcgagacaagaaaccgaagggaaacgaccccctaaactccgtagtacttacgtttaacggtcgtacttacgtttaaggaaggtaggttcggggtacccagtacgtaaggttcaggcgcgtaggtcggagtcgtagggacacgtacttcaacgtcctcctaaccgtacgttacccaaccgtacgtccgtacgacgtacggtcctagtacgtttagtttacttttaccggaaccttaaaccgttacctttaacgacgtaaccctaaacgtacgttagttacggttacgttacttacccgttacgttacccggttttccgacccggtacgggtaaacctaaagggtacgtaagttaaccgtaacgtaacgtacgtggtacgtacgtacggacctacctagttccttgttaccttcaccttcccgttcccgtaccg

SEQ ID NO: 19288 - DNA, 667 bp, Homo sapiens
  misc_feature: GYAE6OF02GWMFH.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggctcctgctgctctggctcccaggtgccaaatgtgacatccagctgacccagtctccctccaccctgtctgcatctgtaggagaagcgtcaccatcacttgccgaccagtcagagtattagtattggtgctgtatcagcagaaccagggaaacgaccctaaactcctagattacttaaggcgttactacgtttagagaggtcggggtacccatacgtaaggttcaggcggcaggtaggtatcgtagggacgagtacttcaccttctaccacctactaccaccgacgtcctacgacgacgtccgtagacgttgttagttttcgaccttaacccttatttaccgtacgtacccgtaaacgtaggttagttcgggttacgtacgtttcccgttacccgttaccggttttcccgggtcccggttaacggggaaccgttaaacgggttagggtaaaccttacgttaaaccgtaaacgttaacggttggttaacgggtaccttacggacccctaaccgtacgttaccgttcgttaccttaccttaccgtttcccgttccccgtacc

SEQ ID NO: 19289 - DNA, 591 bp, Homo sapiens
  misc_feature: GYAE6OF02JG97M.35.10.A10.1.454.CMB.1.raw
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtacagatcgtcacgaccggtgctcgatttagcgtcgatctcagggggagtcagacccagtcaggacacagcattgacatgagggtccccgctcagctcctggggctcctgctgctctggctcccaggtgccaaatgtgacatccagctcgacccagtcctccctccaccctgtctgcatcgtgtaggagaagcgtcaccatctacgtgaccgacagtcagtagtattagtattggtcgctagtancagcaagaacgaggaacaccctaanctgatacgttaggctactagttagagtacggtcggacacgtcgtaacgttcgaaggccgtntaggngtacgtcgtgggacagtacttcnctactcctacnctaccaccgtgtccgancacgtcctagtgtgttattcgaccttaactcttacgtactaaccgacttagttagtccgtagttcccgttagtcccgttaaccggttccgtaccccggtaaggaacctaagggttctaatacgtaacgtaacgcgtacgttcgccggttacaccgtacgttactacgtttcctacgttactaccgttcccgtaccctacg

SEQ ID NO: 19290 - DNA, 632 bp, Homo sapiens
  misc_feature: GYAE6OF02IRRTP.35.10.A10.1.454.CMB.1.raw
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (612)..(612): a, c, t, g, unknown or other
  misc_feature (612)..(612): n is a, c, g, or t
tcagtacagatcgtcacgaccggtgctcgatttagcgtcgatctcagggggagtcagacccagtcaggacacagcatggacatgagggtccccgctcagctcctggggctcctgctactctggctccgaggtgcccagatgtgacatccagatcgacccagtctccactccctccctgtctgctatctgtaggagacagcgcaccntcacttcgccgggcaagtcgagacnctagttcggctagttactttaagttgtatacaacggaaacgaggaactaccctaactctgtatctatcgctgtctacttaccttatttacggacgtaacgggtccggggtaccgacgttaacggtactaggtacggcgtaggtcggatcggtacggactaagtacttacctactcctacctaactagtacgacgtgttaccgtcctaccggtaacctaacgtacggtaagttaacgtttcaccgttaaacttagtacttataccggtaatacggtacgtacgacgccgtaccgctacgtactacgtcccgtacggaccgtaacggcctaaggacggtaaggtaaagtaaacgttaagtaccggttaggtacctggttaccnctaacgttccgtaggttccc

SEQ ID NO: 19291 - DNA, 781 bp, Homo sapiens
  misc_feature: GYAE6OF02IG4G8.35.10.A10.1.454.CMB.1.raw
  modified_base (131)..(131): a, c, t, g, unknown or other
  misc_feature (131)..(131): n is a, c, g, or t
  modified_base (135)..(135): a, c, t, g, unknown or other
  misc_feature (135)..(135): n is a, c, g, or t
  modified_base (356)..(356): a, c, t, g, unknown or other
  misc_feature (356)..(356): n is a, c, g, or t
tcagtacagatcgtcacgaccggtgctcgatttagcgtcgatctcagggggagtcagacccgagtcaggacacagcatggacatgagggtccccgctcagctccgtggggctcctgctactctggctccgnggtnccagatgtgacatccgagatcgacccagtcctccatccctccctgtctgcactcgtagtaggacgacagccgtacaacctactccacgttcggaccgggacaagtcaagagtctaagttcggactaagtttactttaaagttcggtaactaaccggtaaacggaaaaccggaacggaaaccgtaaccccttaaacgtccgtaatacttactagtcgtcgtnactacgtccttagtttacgaacgtaacgggtccgggtaccgtacgtaacggtacgacggtggacgtaggtagacgtacggtaacggtaacacgttaaacttcctaaccttcctaaccgtaccaactaccgtaacgtaaccgtcgtacgtaaccggaacttaaaccggtacggtaaacgttttaccgtttaaccgaaaccctttaaaccgtttacttaacggtttaaccgtaacccgtaaacgtaacggttaacccgttaaccggtaaccggttaaccccgcccggtaacgtaaccttaccgggacgttaccggtaccggaaccgggaacgggtaccgtaacggtaccggtaaggtaaacgttaaacgtaaaacggtacgttggtacggtacctacggtaacccttacggtacttaccgtttaccg

SEQ ID NO: 19292 - DNA, 851 bp, Homo sapiens
  misc_feature: GYAE6OF02GQUDB.35.10.A10.1.454.CMB.1.raw
  modified_base (830)..(830): a, c, t, g, unknown or other
  misc_feature (830)..(830): n is a, c, g, or t
tcagtacagatcgtcacgaccggtgctcgatttagcgtcgatctcagggggagtcagacccagtcaggacacagcatggacatgagggtccccgctcacgctccgtggggctcctgctgctctggcctcccaggtgcctaaagtcgtgacataccagctcgaccctagtcctccctcctacctgtctagctactcgtagtaacggaacgaacggtcctaccgaacctacttaccgtaacgttccgggaaccccggtacctaacggtaccgaagtaacgttagtttaaacggttaacggtttcgggttcggtacccgttaggtaaccgtacggtaaccggaccgaaaacggtaaaacccggtaacggggaaaccccgttaacccccgttaaaaccgttaccccgttaaggtaaccgttttaacggttaaccggttacccgttaacgtttaacggttacggtacgggtaaccggttacggggtacccctaagtaacccgttaagggttaccgcgggtacctaggacggttacggacggttaccggaacgggtaccgtaacggtacttaccgtacccgtaaccgtacctaacccgtactacccgtacccggtaacgtccgtaaccgtcgacgtcggtaacttcgttaagttaccgtttcaaacccgttacgttacgtacctaaccggtaactaggttaccgtaaggttcggtaccttaacgtttccgactttccgtccggtaccgtacgggtaacctaaggtactacgtaacgtaccgtaacgtcgttcggattccgtaaccgtcctaacgtttcgactttacgacccttacncccggtttaccccgctaaccg

SEQ ID NO: 19293 - DNA, 969 bp, Homo sapiens
  misc_feature: GYAE6OF02HULIT.35.10.A10.1.454.CMB.1.raw
  modified_base (151)..(151): a, c, t, g, unknown or other
  misc_feature (151)..(151): n is a, c, g, or t
tcagtacagatcgtcacgaccggtgctcgatttagcgtcgatctcagggggagtcagacccagtcaggacacagcatggacatgagggtccccgctcagctcctggggctcctgcctgctctggcctcccgaggtgaccaaatggtcactnttcccagctacgacccagtcctcccctcccacccttgctcgacatctaggtaaggaagaaacgccgtctaccatacgaccgttaccggccggtaccagtaccgagtagttagttaagtttaagttgggtttcggaccgttaggtactacaacgtacgaaaaccggaaacggaaaccggggtaaaccaacccccgttaaaacccgcccgtttacgaacgttttacgtttaaccgggtacgtttaacccgtttaaccggtttaacggtaggttaacgggtttacccgggtaacccccgtaacggttaacccgttaacggttaacggtaccggtaccggtccggtaagttacgggtacgttacggtaacgggggtaaccgaacggtttaccctaaccggttaacccctttaccgtaaacccccaaaccttaaccctacccgaaaacccgttaccggtaccccgtacggtaccgtaacccggtccgttaacgggtacgtttaacgtttacgtttacccgttaaccgtaaaccctttaacgtttacccgttaacgttaaccccgtaaacgttaacgttacggttaaacggtccgttttacccgtttacccggtttaaccggttaccccgttttacccggggacccgggttaaacccgggtaacggttaaaaccgttaacggtaaccgtttaaaccgaaacccgttaaacgtacccggttagggttacccgggacgttaacccggtaccgttaaaccccgtcgtttcccggtacgttttaccccgttacgtttaccctttccccccgttaacccggttccccgg

SEQ ID NO: 19294 - DNA, 783 bp, Homo sapiens
  misc_feature: GYAE6OF02HK3GD.35.10.A10.1.454.CMB.1.raw
  modified_base (253)..(253): a, c, t, g, unknown or other
  misc_feature (253)..(253): n is a, c, g, or t
tcagtacagatcgtcacgaccggtgctcgatttagcgtcgatctcagggggagtcagacccagtcaggacacagcatggacatgagggtccccgctcagctcctggggctcctgctgctctggcctcccgaggtgaccaaatgtgacatccagctcgacccagtcctccctaccaccctgtctgctatcgtgtaggaagaagcgtacaccatcactcgccgacagtcagtatattagtagttggtcgctgtancagacaacgaaaccagggtaacacccctaatcctatattacgttaacggcttacttagttagaggtcggtcggtaccagtaccgtaaggttccgaggaccggacgtaggtacggtacgtacggtaggggaacctacggttaaccgttacccaccgtttacccacccgtaaaccctaataaccccgtaccgtacccttacccgtacgtacccgtaccggtaccgtttacggacggtttttagttacctttttaccgaaacccctttaaaccgtttaccgttaaccgtaccggtaacccgttaaacgttaggtttaacgttcgggttaacgtttacccgtttacccccggttactttacccgggtccccgggtttaacccgggtacggtaaaacccggttaaggtaacgaacggtttaaccaaaccgtaaaccgggtttcgtcgggtaccggttaccgtacgtaaacccctactttcggtttaccggttccgtttaacctaccgtttacccgttcccgttacccccgttaac

SEQ ID NO: 19295 - DNA, 710 bp, Homo sapiens
  misc_feature: GYAE6OF02G5FD8.35.10.A10.1.454.CMB.1.raw
  modified_base (236)..(236): a, c, t, g, unknown or other
  misc_feature (236)..(236): n is a, c, g, or t
  modified_base (541)..(541): a, c, t, g, unknown or other
  misc_feature (541)..(541): n is a, c, g, or t
  modified_base (635)..(635): a, c, t, g, unknown or other
  misc_feature (635)..(635): n is a, c, g, or t
  modified_base (666)..(666): a, c, t, g, unknown or other
  misc_feature (666)..(666): n is a, c, g, or t
  modified_base (694)..(694): a, c, t, g, unknown or other
  misc_feature (694)..(694): n is a, c, g, or t
tcagtacagatcgtcacgaccggtgctcgatttagcgtcgatctcgagggggagtcagacccagtcaggacacagcattgacatgacgggtccccgctcagctccgtgggctctgctgctctggctccgaggtgaccaatgtgacactccagctcgacctgtcctccctccacctgtctgcatctaggtaggagaacgtcgtacacactcacgttcgaccggacacgtcgaaggtnttaagttagttaagttcgggttcggccgttgggtactacgagaccgtaaggaaaccggaagggtaacctacccccgtaaaacttcgtacggttaactttacggtaacggtccttacgtttaacgttagacgggttacggtccgggttaccctaagtccgtaaacgggttcgacggacggtacgacggtacggtacttcgggtacggaattaaccggtacttaccgacgttcctaaccgacctataccgaccgtacgccgtagaccgtacgtcgttacgtagtcgttacttacgaacttaaccgtntaccggtacaccgtaatggtacgtcttacgacgttacgtacccttccggttacccgggaccggtaacggtaaccgtaacggttgtaaaccctanaaccgtaacgggttctacgggtctaaccggntaaccggtactcgttacgtcttaccgtntaccgttccgactacg

SEQ ID NO: 19296 - DNA, 867 bp, Homo sapiens
  misc_feature: GYAE6OF02GNEFM.35.10.A10.1.454.CMB.1.raw
tcagtacagatcgtcacgaccggtgctcgatttagcgtcgatctcagggggagtcagacccagtcaggacacagcatggacatgagggtccccgctcagctcctggggatcctgctgctctggcctccgaggtgaccaaatgtgacatccagctcgaccctacgtcctccctcccaccctgtctgcatctaggtaggagaacgcgtcacctataccgtacgttacggaccggactacgtcgacgtagttagttaaggttaacttgggttcggaccttggtatctaggaccaacgaaaccggaacgggaaactaccccgtaaccttccgtagtattaccgttaaggtaccgttacgttaacgttaggacgtaggtaccgggtacctaagtaccggtaagttccgaaggccggacgtagtacggtagtcggtacgggacgaacgttaccttactccgtacctaccgtactaaccgtcccaaccgtacgtcccagggttaccacggtacccgttaggtacttaaggtttccgttacgtaaaccgtaaccctttaggttaaccgttaccgtaaaacccggttagttaaacgggttacggttacggtttaacgtttacccggtttaccggttttaaccccgtttacccggggtttaaccggttcccgggttaaaccgggttaaacccgggtttaaaacggttacccgggttaaagttaacccgttaaaacggttaacccccgggtaaggttaaccggggttaccgttaaacggttcccggtaaccgttaaccgttacccggtttacggtttaacctttttacccggttaacccgtttaaccccgttttaccccgggtaccctttaaaccccg

SEQ ID NO: 19297 - DNA, 930 bp, Homo sapiens
  misc_feature: GYAE6OF02HXZSV.35.10.A10.1.454.CMB.1.raw
tcagtacagatcgtcacgaccggtgctcgatttagcgtcgatctcagggggagtcagacccagtcaggacacagcatggacatgagggtccccgctcagctccgtgggctcctgctgctctggctcccgaggtcgacctaaatcggtgactactccgagtcgtacgaccctaggttccctccccctaccctacccgttggttcctggtacctacgttcgtagggttaagggaacggtaaaacgtccggttaccaacccgttaacgtaccgttaccgttaccgggacccggtaacccgtaaggttaccgtaacggttaacggtttaaactttaacgggttaaacgttttcggggggttaccggtaccgtttacggggttaaacgtaccgtaaacggtaccggtaaaaccggaaaaccgggttaacggggaaaaccgttaacccccttaaacgttaccgttacgtaacgtttaccgtttaacgggtaccgtttaaccgttaacggttttaacgggaacggtaccggggttacccggggttaacctaaggttaaccggtaacggtttccgaacggtccgggtaacgtacggtacggtacgggttaccgtacggggaacttacgggtcccttacgtaccgtacctaccgaacgtaccgtaccgacggtacgtccgaacgtccgtaaccgtacgtacggtacgttacgttcgtttaccaaacccgttaccgtttaaagttcccgacggtaaccgtaaccgttaggtttagtaccggtttaaaccgtccgttaacggttacccgtacccggtttccgaaccgggtaggtaaccttaaggttcgtaaactacgttaaccgacgtacgttggaccgtttaacgccgtaactaccggtacttccggttattacccttaacggtccttacccgacgtacg

SEQ ID NO: 19298 - DNA, 759 bp, Homo sapiens
  misc_feature: GYAE6OF02GAN7T.35.10.A10.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtacagatcgtcacgaccggtgctcgatttagcgtcgatctcagggggagtcagacccagtcaggacacagcatggacatgacgggtccccgctcagctccgtggggctcctgctgctcgtggcctcccgaggtcgacctaaatgtgacatccaggctcgaccctagtcctccctccacccttgtctgctactcgtgtaagganaacgcgtaccacncttcacgttcggcccgtactgcgagtagttattaggtatttgggttcgcgttgtaactcgagaccgaacgaaacgaacggtaaccgaccccttaaacgtcctgtacttacgttaacggcgttacttacgttagacggacgttcgggcctaagtacgtaggtcgacggcgacgtaggtcgtcgtcggtcggactacgtacgttcgtaacgttccaccctaccagttacccacgtacctccgtacgctccggcgttagacttacgttacgtttacgaaccgtttaacctaacggttaccgtaactaccgttaaacgtacggttgttagttaccggtttaccgtaccggtttacccgttacccggtttacccgggtaccggttaacgggtaacgttaacgggtacgtaaacgttaaccgtaacggaaccccttagggtacccggttaagggtccccttacggaacccgttaaccgttaccggttttcgttaacgtttccccgtttaacggttacccgtttccccggtaacccgtttacccgg

SEQ ID NO: 19299 - DNA, 170 bp, Homo sapiens
  misc_feature: GYAE6OF01DVT89.11.35.D02.1.454.CMB.1.raw
  modified_base (170)..(170): a, c, t, g, unknown or other
  misc_feature (170)..(170): n is a, c, g, or t
tcagcgagagataccacgaccggtgctcgatttagcacacgatagttgggtttgggggaagaggaagactgacggtcccccaggagttcaggtgctgggcacagcggccctgggctgcctggtcaaggactactttatctctcgctgagcgggctggcaaggcgcatagn

SEQ ID NO: 19300 - DNA, 173 bp, Homo sapiens
  misc_feature: GYAE6OF02I4X9F.11.35.D02.1.454.CMB.1.raw
  modified_base (172)..(173): a, c, t, g, unknown or other
  misc_feature (172)..(173): n is a, c, g, or t
tcagcgagagataccacgaccggtgctcgatttagcacacgatagttgggtttggggaagaggaagactgacggtcccccaggagttcaggtgctgggcacagcggccctgggctgcctggtcaaggactacttccgtatctctcgctgagcgggctggcaaggcgcatagnn

SEQ ID NO: 19301 - DNA, 178 bp, Homo sapiens
  misc_feature: GYAE6OF02GO5X8.11.35.D02.1.454.CMB.1.raw
  modified_base (173)..(178): a, c, t, g, unknown or other
  misc_feature (173)..(178): n is a, c, g, or t
tcagcgagagataccacgaccggtgctcgatttagcacacgatagttgggtttgggggaagaggaagactgacggtcccccaggagttcaggtgctgggcacagcggccctgggctgcctggtcaaggactacttccgtatctctcgctgagcgggctggcaaggcgcatagnnnnnn

SEQ ID NO: 19302 - DNA, 168 bp, Homo sapiens
  misc_feature: GYAE6OF01DQZML.10.82.H05.1.454.CMB.1.raw
  modified_base (168)..(168): a, c, t, g, unknown or other
  misc_feature (168)..(168): n is a, c, g, or t
tcagcatagtagtgcacgaccggtgctcgatttagtcgagctctctcgcggggttttcggcggagggaccaagctgaccgtcctaagtcagcccaaggctgccccctcggtcactctgttcccaccctcctccactactatgctgagcgggctggcaaggcgcatagn

SEQ ID NO: 19303 - DNA, 166 bp, Homo sapiens
  misc_feature: GYAE6OF01C5FKV.10.82.H05.1.454.CMB.1.raw
  modified_base (166)..(166): a, c, t, g, unknown or other
  misc_feature (166)..(166): n is a, c, g, or t
tcagcatagtagtgcacgaccggtgctcgatttagtcgagctctctcgcggggtttcggcggagggaccaagctgaccgtcctaagtcagcccaaggctgcccctcggtcactctgttcccaccctcctccactactatgctgagcgggctggcaaggcgcatagn

SEQ ID NO: 19304 - DNA, 169 bp, Homo sapiens
  misc_feature: GYAE6OF01A5LQZ.10.82.H05.1.454.CMB.1.raw
  modified_base (169)..(169): a, c, t, g, unknown or other
  misc_feature (169)..(169): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccgccctcctccactactatgctgagcgggctggcaaggcgcatagn

SEQ ID NO: 19305 - DNA, 168 bp, Homo sapiens
  misc_feature: GYAE6OF01B7I0Q.10.82.H05.1.454.CMB.1.raw
  modified_base (167)..(168): a, c, t, g, unknown or other
  misc_feature (167)..(168): n is a, c, g, or t
tcagcatagtagtgcacgaccggtgctcgatttagtcgagctctctcgcggggtttcggcggagggaccaagctgaccgtcctaagtcagcccaaggctgccccctcggtcactctgttcccaccctcctccactactatgctgagcgggctggcaaggcgcatagnn

SEQ ID NO: 19306 - DNA, 169 bp, Homo sapiens
  misc_feature: GYAE6OF01DJWKB.10.82.H05.1.454.CMB.1.raw
  modified_base (169)..(169): a, c, t, g, unknown or other
  misc_feature (169)..(169): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccaccctcctccactactatgctgagcgggctggcaaggcgcatagn

SEQ ID NO: 19307 - DNA, 170 bp, Homo sapiens
  misc_feature: GYAE6OF01EDWZI.10.82.H05.1.454.CMB.1.raw
  modified_base (169)..(170): a, c, t, g, unknown or other
  misc_feature (169)..(170): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccaccctcctccactactatgctgagcgggctggcaaggcgcatagnn

SEQ ID NO: 19308 - DNA, 173 bp, Homo sapiens
  misc_feature: GYAE6OF01AIVR9.10.82.H05.1.454.CMB.1.raw
  modified_base (169)..(173): a, c, t, g, unknown or other
  misc_feature (169)..(173): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccgccctcctccactactatgctgagcgggctggcaaggcgcatagnnnnn

SEQ ID NO: 19309 - DNA, 182 bp, Homo sapiens
  misc_feature: GYAE6OF01BYUZM.10.82.H05.1.454.CMB.1.raw
  modified_base (168)..(182): a, c, t, g, unknown or other
  misc_feature (168)..(182): n is a, c, g, or t
tcagcatagtagtgcacgaccggtgctcgatttagtcgagctctctcgcgggggttttcggcggagggaccaagctgaccgtcctaagtcagcccaaggctgccccctggtcactctgttccccaccctcctccatactatgctgagcgggctggcaaggcgcatagnnnnnnnnnnnnnnn

SEQ ID NO: 19310 - DNA, 168 bp, Homo sapiens
  misc_feature: GYAE6OF02G0XB6.10.82.H05.1.454.CMB.1.raw
  modified_base (167)..(168): a, c, t, g, unknown or other
  misc_feature (167)..(168): n is a, c, g, or t
tcagcatagtagtgcacgaccggtgctcgatttagtcgagctctctcgcggggttttcggcggagggaccaagctgaccgtcctaagtcagcccaaggctgcccctcggtcactctgttcccgccctcctccactactatgctgagcgggctggcaaggcgcatagnn

SEQ ID NO: 19311 - DNA, 168 bp, Homo sapiens
  misc_feature: GYAE6OF02H58P3.10.82.H05.1.454.CMB.1.raw
  modified_base (167)..(168): a, c, t, g, unknown or other
  misc_feature (167)..(168): n is a, c, g, or t
tcagcatagtagtgcacgaccggtgctcgatttagtcgagctctctcgcggggttttcggcggagggaccaagctgaccgtcctaagtcagcccaaggctgcccctcggtcactttgttcccaccctcctccactactatgctgagcgggctggcaaggcgcatagnn

SEQ ID NO: 19312 - DNA, 167 bp, Homo sapiens
  misc_feature: GYAE6OF02HFEXW.10.82.H05.1.454.CMB.1.raw
  modified_base (167)..(167): a, c, t, g, unknown or other
  misc_feature (167)..(167): n is a, c, g, or t
tcagcatagtagtgcacgaccggtgctcgatttagtcgagctctctcgcggggttttcggcggagggaccaagctgaccgtcctaagtcagcccaaggctgcccctcggtcactctgttcccgccctcctccactactatgctgagcgggctggcaaggcgcatagn

SEQ ID NO: 19313 - DNA, 167 bp, Homo sapiens
  misc_feature: GYAE6OF02GS6Q9.10.82.H05.1.454.CMB.1.raw
  modified_base (167)..(167): a, c, t, g, unknown or other
  misc_feature (167)..(167): n is a, c, g, or t
tcagcatagtagtgcacgaccggtgctcgatttagtcgagctctctcgcggggttttcggcggagggaccaagctgaccgtcctaagtcagcccaaggctgcccctcggtcactctgttcccaccctcctccactactatgctgagcgggctggcaaggcgcatagn

SEQ ID NO: 19314 - DNA, 167 bp, Homo sapiens
  misc_feature: GYAE6OF02H0KW5.10.82.H05.1.454.CMB.1.raw
tcagcatagtagtgcacgaccggtgctcgatttagtcgagctctctcgcggggttttcggcggagggaccaagctgaccgtcctaggtcagcccaaggctgccccctcggtcactctgttcccgccctcctccactactatgctgagcgggctggcaaggcgcatag

SEQ ID NO: 19315 - DNA, 169 bp, Homo sapiens; identical to SEQ ID NO: 19304
  misc_feature: GYAE6OF02FGINZ.10.82.H05.1.454.CMB.1.raw
  modified_base (169)..(169): a, c, t, g, unknown or other
  misc_feature (169)..(169): n is a, c, g, or t

SEQ ID NO: 19316 - DNA, 169 bp, Homo sapiens; identical to SEQ ID NO: 19306
  misc_feature: GYAE6OF02G7KN2.10.82.H05.1.454.CMB.1.raw
  modified_base (169)..(169): a, c, t, g, unknown or other
  misc_feature (169)..(169): n is a, c, g, or t

SEQ ID NO: 19317 - DNA, 172 bp, Homo sapiens
  misc_feature: GYAE6OF02GIURH.10.82.H05.1.454.CMB.1.raw
  modified_base (169)..(172): a, c, t, g, unknown or other
  misc_feature (169)..(172): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccgccctcctccactactatgctgagcgggctggcaaggcgcatagnnnn

SEQ ID NO: 19318 - DNA, 170 bp, Homo sapiens
  misc_feature: GYAE6OF02G6HOB.10.82.H05.1.454.CMB.1.raw
  modified_base (169)..(170): a, c, t, g, unknown or other
  misc_feature (169)..(170): n is a, c, g, or t
tcagcatagtagtgcacgaccggtgctcgatttagtcgagctctctcgcgggggttttcggcggagggaccaagctgaccgtcctaagtcagcccaaggctgccccctcggtcactctgttcccgccctcctccactactatgctgagcgggctggcaaggcgcatagnn

SEQ ID NO: 19319 - DNA, 176 bp, Homo sapiens
  misc_feature: GYAE6OF02F3IYJ.10.82.H05.1.454.CMB.1.raw
  modified_base (168)..(176): a, c, t, g, unknown or other
  misc_feature (168)..(176): n is a, c, g, or t
tcagcatagtagtgcacgaccggtgctcgatttagtcgagctctctcgcgggggttttcggcggagggaccaagctgaccgtcctaagtcagcccaaggctgccccctggtcactctgttcccgccctcctccactactatgctgagcgggctggcaaggcgcatagnnnnnnnnn

SEQ ID NO: 19320 - DNA, 489 bp, Homo sapiens
  misc_feature: GYAE6OF01CV46I.10.40.D07.1.454.CMB.1.raw
  modified_base (476)..(489): a, c, t, g, unknown or other
  misc_feature (476)..(489): n is a, c, g, or t
tcagcatagtagtgcacgaccggtgctcgatttagtgatagagcgtaacaacaggagggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtccatttcctggccatcaatgggctcaggctgaagatgagctgattactactgccagtcgtatgacaccaagctgaaactttgggtcttcgggcggagggaccaggctgaccgtcctacgtcagcccaagctcgccccctcggtccactctcgttcccgccctcctccactactatcgctgagcggctcggcgaaggccgcacgtagcnnnnnnnnnnnnnn

SEQ ID NO: 19321 - DNA, 483 bp, Homo sapiens
  misc_feature: GYAE6OF01EF1LX.10.40.D07.1.454.CMB.1.raw
  modified_base (474)..(483): a, c, t, g, unknown or other
  misc_feature (474)..(483): n is a, c, g, or t
tcagcatagtagtgcacgaccggtgctcgatttagtgatagagcgtaacaacaggaggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcgggcggagggaccaggctgaccgtcctacgtcagcccaaggctcgccccctcggtcactctcgttcccaccctcctccactactatgctgagcggctcggcaaggcgcatagnnnnnnnnnn

SEQ ID NO: 19322 - DNA, 605 bp, Homo sapiens
  misc_feature: GYAE6OF01C00SA.10.40.D07.1.454.CMB.1.raw
  modified_base (367)..(367): a, c, t, g, unknown or other
  misc_feature (367)..(367): n is a, c, g, or t
  modified_base (440)..(440): a, c, t, g, unknown or other
  misc_feature (440)..(440): n is a, c, g, or t
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
tcagcatagtagtgcacgaccggtgctcgatttagtgatagagcgtaacgtaacggagagggtccgaggggcccaatatgttctgacacagccgccctcagtgtccggggccccgggcagcggtcaccatctcctgcactggggaacaacttcgaacagtcggggcagcttacgatcgtccactcggtactccgccaaccttccacggcacagacccccaaaaatccgtaccttctatggtgacttcaatccggccctcaggggtccctgtaccgcttctctggcttcaacgtctggccacgtatacgaccacgtcccaatttccctaggtccctattcaagtcgggctaccgaggcctagaaagtntcgaggctgtacttactactcgccagtcgtatgacacgaacgctagaacgtttggtctcgggcggtaggaccnggtcgtgaccgtctacgcacgcccaaggctccggcccctcggtccacgttcctacgttccccgacccttccctaccgtacgttacgtacgtcgggcctaggacggtccgggtcgtcgggacgtaacgggccgactaagtacgcgctacgctacgnacgcncgtac

SEQ ID NO: 19323 - DNA, 494 bp, Homo sapiens
  misc_feature: GYAE6OF01EFOP8.10.40.D07.1.454.CMB.1.raw
  modified_base (470)..(470): a, c, t, g, unknown or other
  misc_feature (470)..(470): n is a, c, g, or t
  modified_base (478)..(494): a, c, t, g, unknown or other
  misc_feature (478)..(494): n is a, c, g, or t
tcagcatagtagtgcacgaccggtgctcgatttagtgatagagcgtaacaacaggaggggggggtgagggatgagaacctatgaacattctgtaggggtcaccatctcctgcactgggaacaacttcaacatcggggcagcttacgatgtccactggtatcaccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgagatgaggctgattacactgccagtcgtatgacaccaagctgaaactttgggtcttcgggcggagggaccaggctgaccgtctacgtcacgcccaaggctcgccccctcggtccactctcgttccccaccctcctcctactactactgctgagccggctggcaaggcncgagtagnnnnnnnnnnnnnnnnn

SEQ ID NO: 19324 - DNA, 542 bp, Homo sapiens
  misc_feature: GYAE6OF01ESPOS.10.40.D07.1.454.CMB.1.raw
  modified_base (473)..(473): a, c, t, g, unknown or other
  misc_feature (473)..(473): n is a, c, g, or t
  modified_base (532)..(533): a, c, t, g, unknown or other
  misc_feature (532)..(533): n is a, c, g, or t
  modified_base (536)..(542): a, c, t, g, unknown or other
  misc_feature (536)..(542): n is a, c, g, or t
tcagcatagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcacacgcccccaaaatcgtcttctatggtgacttcaatcggccctcacggggtccctgaccgcttctctggcttcaagtctggcacgtatgacacgtcccatttcctggccatcaagtcgggcctccgaggctagaagatgaggtctgtattactactgcctagtcgtatcgaccaccaagtctagtaaacgtttgggtcgttcgggcgggacgggaccgaggctcgacccgtcctacgtcgacgcccagctccgccccgtcgtcactctccgtcccnccctcctccactactactcgctcggacggtcgggcgtcggacgacggccgacagtagcnncgnnnnnnn

SEQ ID NO: 19325 - DNA, 577 bp, Homo sapiens
  misc_feature: GYAE6OF01CW6YW.10.40.D07.1.454.CMB.1.raw
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (494)..(494): a, c, t, g, unknown or other
  misc_feature (494)..(494): n is a, c, g, or t
  modified_base (560)..(570): a, c, t, g, unknown or other
  misc_feature (560)..(570): n is a, c, g, or t
  modified_base (572)..(577): a, c, t, g, unknown or other
  misc_feature (572)..(577): n is a, c, g, or t
tcagcatagtagtgcacgaccggtgctcgatttagtgatagagcgtaacaacaggaggggggggtgagggatgagaacctatgaacattctgtaggggtcaccatctcctgcactgggaacaacttcaacatacggggcagcttacgatgtccactggtatcgcctaacttccaggcacacgacccccaaaatccgtcttctatggtgacttcaatccggccctcgacggggtccctgacccgctttcctcgtggcttcaagtctggcacgtatgacacgtccctatttcctggccattcaagtcgggctccgaggctagaanatggagctagacttactatgcctagtcgtangactaaccgagactagtaaacgttttcggggacttcgggcgggaagggaccagggtaccgtacgacccggtcctacgtccgacgtacccaagggtcctaccgtccccgttcgggtcctaccgttcgtccgggttcccccncccttccctctactacttgtcgtactcggaacggtccgggactcgggactaacggcacgagaggcnnnnnnnnnnncnnnnnn

SEQ ID NO: 19326 - DNA, 573 bp, Homo sapiens
  misc_feature: GYAE6OF01ELMXN.10.40.D07.1.454.CMB.1.raw
  modified_base (448)..(448): a, c, t, g, unknown or other
  misc_feature (448)..(448): n is a, c, g, or t
tcagcatagtagtgcacgaccggtgctcgatttagtgatagagcgtaacaacaggagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaagtggaagcgaaagtgactatttggttacttttaaattttgtcttctttggtacctaacagacgcccaagaaccaaagacccccctaaaaattatctatttctgctgtcagtaatcgccctgagggtttctagtcgcttctctgctcagtctgcacacggcctcctgacctatctcgtggcctcgaggctgaggacgaggctagtatttattagttgcagtctanaataacaacaaaccacgtaaagtctttagattacgtcgggaggacggaaccaaagttccggaccttccgttcgtcacgaccccgtaacggtcccttccgacccccgttcggtccctcgttccccg

SEQ ID NO: 19327 - DNA, 580 bp, Homo sapiens
  misc_feature: GYAE6OF01C2LL5.10.40.D07.1.454.CMB.1.raw
  modified_base (269)..(269): a, c, t, g, unknown or other
  misc_feature (269)..(269): n is a, c, g, or t
  modified_base (388)..(388): a, c, t, g, unknown or other
  misc_feature (388)..(388): n is a, c, g, or t
  modified_base (563)..(565): a, c, t, g, unknown or other
  misc_feature (563)..(565): n is a, c, g, or t
  modified_base (567)..(580): a, c, t, g, unknown or other
  misc_feature (567)..(580): n is a, c, g, or t
tcagcatagtagtgcacgaccggtgctcgatttagtgatagagcgtaacaacaggagggggggggtgagggatgagaacctatgaacattctgtaggggtcaccatctcctgcactgggaacaacttcaacatcggggcagcttacgatgtccactggtatcgccaacttccaggcacacgcccccaaaatccgtcttctatggtgacttcaatcggccctcgacggggtccctgaccgcttcctctggcttcaagtcgtggcacgtancgacaccgtccatttcctggccatcaagtgggctccaggctagaagatcggaggctgtattactactcgccagtcgtatgaacctaccaagtctagtaaacgtttgggtacgttcgggnggacgggtaccgaggctcggaacccgttccgtacgtacaccggcccgaaacggcctacccggtcccccgtcgggtacccaccgttccttccggtttccccctaccccttccctaccctaccttactactccgtcgttcggacggtcggtcgtggaccgaacggcgacagtacgtnnngnnnnnnnnnnnnnn

SEQ ID NO: 19328 - DNA, 518 bp, Homo sapiens
  misc_feature: GYAE6OF01BOG2D.10.40.D07.1.454.CMB.1.raw
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (493)..(493): a, c, t, g, unknown or other
  misc_feature (493)..(493): n is a, c, g, or t
  modified_base (501)..(504): a, c, t, g, unknown or other
  misc_feature (501)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(518): a, c, t, g, unknown or other
  misc_feature (511)..(518): n is a, c, g, or t
tcagcatagtagtgcacgaccggtgctcgatttagtgatagagcgtaacaacagagggggggggtgagggatgagaacctatgaacattctgtaggggtcaccatctcctgcactgggaacaacttcaacatcggggcagcttacgatgtccactggtatcgccaacttccaggcacacgcccccaaaatcgtcttctatggtgacttcaatcggccctcgagggtccctgaccgcttctctggctcaagtctggcacgtatgacacgtccctatttcctggccatcaatgggctccaggctagaagngtgnggctgacttactactgccagtcgtatgaaccacaagctagtaaacgtttgggtacttcgggcggagggaccaggcgtcgaccgtcctacgtcacgcccgaaggcctcgtccccctcgtcactccgtcgttccccgcccctccctccacctactctcgctgacggcggcgtggcgaacggcncgaactgnnnngnangcnnnnnnnn

SEQ ID NO: 19329 - DNA, 822 bp, Homo sapiens
  misc_feature: GYAE6OF01AK3TX.10.40.D07.1.454.CMB.1.raw
  modified_base (803)..(803): a, c, t, g, unknown or other
  misc_feature (803)..(803): n is a, c, g, or t
  modified_base (806)..(806): a, c, t, g, unknown or other
  misc_feature (806)..(806): n is a, c, g, or t
  modified_base (808)..(808): a, c, t, g, unknown or other
  misc_feature (808)..(808): n is a, c, g, or t
  modified_base (813)..(813): a, c, t, g, unknown or other
  misc_feature (813)..(813): n is a, c, g, or t
  modified_base (817)..(818): a, c, t, g, unknown or other
  misc_feature (817)..(818): n is a, c, g, or t
  modified_base (820)..(822): a, c, t, g, unknown or other
  misc_feature (820)..(822): n is a, c, g, or t
tcagcatagtagtgcacgaccggtgctcgatttagtgatagagcgtaacaacagagggggggtgagggatgagaactatgaacattctgtagggtcaccatctcctgcactaggaacacttcaacacgtcgggcagtcttacgatcgtccatgtatcgacctaactcaggcactacgaccccaaatcgtcttctagttcgtcgtacttcgaacgtccgccctggacggggtcccttcgacccgttcttaccgtcgtacggtacctttgaaccggtttctcggacctaccggttaagtccgtaacccgtacccggttaccccttagttttccccggttcggaccctagttaacctaacggttcggggaccttacccggaggttaccggtaggaaacggtaccgttacgggtacgtacgtttaacgttaacggttttaaaccacggttaccggtaacccgtaagtttaccggttaacggtaccctaaccgtaaacccggaatttaccggtttaaacggttaacggttttccggggtttactaccgggggaacggtaccgggttaaccgacggtttcctaaccgggtacccgttaaccgtaccgtacgttacccgaaccggtaccggtccgtacccggtaccccgtaccggtaccgtacctttacccggttccccgttaccccgtaccccttccccgtaacccgttaccttacccgtacgttacccgtctaccggggtaaccggtccggttaaccgtaccgggtaaccgaaccgggccttacgaacgttccgagctcgcctgtacngcncncacgntacnncnnn

SEQ ID NO: 19330 - DNA, 887 bp, Homo sapiens
  misc_feature: GYAE6OF01BD5KN.10.40.D07.1.454.CMB.1.raw
  modified_base (863)..(863): a, c, t, g, unknown or other
  misc_feature (863)..(863): n is a, c, g, or t
  modified_base (871)..(871): a, c, t, g, unknown or other
  misc_feature (871)..(871): n is a, c, g, or t
  modified_base (879)..(879): a, c, t, g, unknown or other
  misc_feature (879)..(879): n is a, c, g, or t
  modified_base (883)..(883): a, c, t, g, unknown or other
  misc_feature (883)..(883): n is a, c, g, or t
tcagcatagtagtgcacgaccggtgctcgatttagtgatagagcgtaacaacaggaggggggggtgagggatgagaacctatgaacattctgtagggtcaccatctcctgcactggaacacttcaacatcggggcagcttacgatgtcactggtatcgccaacttcaggcacacgaccccaaaatcgtcttctatggtgtacttacaatccggccctcgtacggggtccctcggtaccgtcttccttcgtcggtctttacgaacgttcgtacggactacggttatacgaccgtaccgttcccttactttccgtacggtacctactactaacggtcgggtcctaccgacggtaccgtaggtaaaggtacgtaggtacggtcgttaacgttacgtttaaccgttaccgtaccgtaccgttacggttaccgtttaagtaccgaacccgtaaaccgtaacgtaccgtttaaacggttaaaccggtttttcggggtaccggtttaccggggaaccggggtaaccgggtaacccgggtaacgggtccggttacccggtaaccccgggttaccccgttaaccgggttaaccccggaacccggtaaccccgggtaacgggtaccccgggttaccccccgggttcccccggttacccggggtaaacccctttccccccggtttaccggttttacccccccgggtttacccccctaaccccggtttaccccctttaacccctaaacccgttttaccgtttaacgtcccgggttaaaacccggtcccgggttaacgggggtccccgggtttaaccgtcccgggggaaaccggaaccgggttacccggattaacggtacggccacgtcgacgcgncgcgcgcncgtcacantgtntacg

SEQ ID NO: 19331 - DNA, 480 bp, Homo sapiens
  misc_feature: GYAE6OF02GUYME.10.40.D07.1.454.CMB.1.raw
  modified_base (468)..(480): a, c, t, g, unknown or other
  misc_feature (468)..(480): n is a, c, g, or t
tcagcatagtagtgcacgaccggtgctcgatttagtgatagagcgtaacaacagagggggggtgagggatgagaacctatgaacattctgtaggggtcaccatctcctgcactgggaacaacttcaacatcgggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctgccccctggtcactctcgttcccaccctcctccactactatgctgagcgggctggcaaggcgcatagnnnnnnnnnnnnn

SEQ ID NO: 19332 - DNA, 483 bp, Homo sapiens
  misc_feature: GYAE6OF02HJF1C.10.40.D07.1.454.CMB.1.raw
  modified_base (471)..(483): a, c, t, g, unknown or other
  misc_feature (471)..(483): n is a, c, g, or t
tcagcatagtagtgcacgaccggtgctcgatttagtgatagagcgtaacaacagaggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctcttgcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctcgccccctggtcactctcgttcccaccctcctccactactatcgctgagcggctggcaaggcgcatagnnnnnnnnnnnnn

SEQ ID NO: 19333 - DNA, 490 bp, Homo sapiens
  misc_feature: GYAE6OF02F2OUS.10.40.D07.1.454.CMB.1.raw
  modified_base (474)..(476): a, c, t, g, unknown or other
  misc_feature (474)..(476): n is a, c, g, or t
  modified_base (478)..(490): a, c, t, g, unknown or other
  misc_feature (478)..(490): n is a, c, g, or t
tcagcatagtagtgcacgaccggtgctcgatttagtgatagagcgtaacaacagaggggggggtgagggatgagaacctatgaacattctgtaggggtcaccatctcctgcactgggaacaacttcaacatcgggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctagaaactttgggtcttcggcggagggaccaggctgaccgtcctacgtcagcccaaggctcgccccctcggtcactctcgttcccgccctcctccactactatcgctgacgcgggctcggcaaggcgcatgnnncnnnnnnnnnnnnn

SEQ ID NO: 19334 - DNA, 672 bp, Homo sapiens
  misc_feature: GYAE6OF02FEQ28.10.40.D07.1.454.CMB.1.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (655)..(657): a, c, t, g, unknown or other
  misc_feature (655)..(657): n is a, c, g, or t
  modified_base (659)..(665): a, c, t, g, unknown or other
  misc_feature (659)..(665): n is a, c, g, or t
  modified_base (667)..(672): a, c, t, g, unknown or other
  misc_feature (667)..(672): n is a, c, g, or t
tcagcatagtagtgcacgaccggtgctcgatttagtgatagagcgtaacaacagaggggggggtgagggatgagaacctatgaacattctgtagggtcaccatctcctgcactggaacaacttcaacatcgggcagcttacgatgtccactggtatcgccaacttccaggcacacgccccaaaatcgtcttctatggtgacttcaactcggccctcgacggggtcccctgaccgtctttcctcgtggcttcgaagttctggcacgtatcgaccaccgtcctactttccnggtaccatcaagtgggcctccaggtctagaagngtggacgtcctagtactttaccacgttcgaccgtagtacgtaatacggaacctaccgtaaagtccgtaagttaaaccggttttcgggtacgttacggggacgggtaacgggtacccgtacgggtcctaccggtacccgtacgtaccggtccgaaccggacccgtaacggtcccttacccggtcccccgttccgggttaccctaaccgttcccgtacccggtttccccgtaccccttcccttaaccctaaccgttaccttacgttccggacggttcgggaaccgggtcccgggtacggttacgggaccgtaaacgggcctaaccgtagtacgcnnngnnnnnnncnnnnnn

SEQ ID NO: 19335 - DNA, 526 bp, Homo sapiens
  misc_feature: GYAE6OF02G3R8K.10.40.D07.1.454.CMB.1.raw
  modified_base (329)..(329): a, c, t, g, unknown or other
  misc_feature (329)..(329): n is a, c, g, or t
  modified_base (480)..(480): a, c, t, g, unknown or other
  misc_feature (480)..(480): n is a, c, g, or t
  modified_base (517)..(526): a, c, t, g, unknown or other
  misc_feature (517)..(526): n is a, c, g, or t
tcagcatagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggcccatcaatgggctccgaggctgaagntgaggctgattactactgccagtcgtatgacacagctagtaaactttgggtcttcgggcgggacgggaccgaggctcgacccgtcctacgtcacgcccgaaggcctcgcccccgtcgtccactcctcgttccccgccctcctccactactntcgctgacgcgggcgtaggcgaacggccgacagtagnnnnnnnnnn

SEQ ID NO: 19336 - DNA, 533 bp, Homo sapiens
  misc_feature: GYAE6OF02GSQ30.10.40.D07.1.454.CMB.1.raw
  modified_base (466)..(466): a, c, t, g, unknown or other
  misc_feature (466)..(466): n is a, c, g, or t
  modified_base (523)..(525): a, c, t, g, unknown or other
  misc_feature (523)..(525): n is a, c, g, or t
  modified_base (527)..(530): a, c, t, g, unknown or other
  misc_feature (527)..(530): n is a, c, g, or t
  modified_base (532)..(533): a, c, t, g, unknown or other
  misc_feature (532)..(533): n is a, c, g, or t
tcagcatagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcacacgcccccaaaaatcgtcttctatggtgacttcaatcggccctcaggggtccctgaccgcttctctggcttcaagtctggcacgtatgacacgtcccatttcctggccatcaatgggcctccgaggctagaagatggaggctgattactactgccagtcgtatgacacaagctagtaaacgtttgggtcttcgggcggagggaccgaggctgaccgtccgtacgtcacgcccgaaggcctcgcccccgtcggtccactctcgttcccnccctcctccactactactcgtctcggacgcgggctcggacgacgggccgacagtagnnncnnnncnn

SEQ ID NO: 19337 - DNA, 488 bp, Homo sapiens
  misc_feature: GYAE6OF02GADAY.10.40.D07.1.454.CMB.1.raw
  modified_base (278)..(278): a, c, t, g, unknown or other
  misc_feature (278)..(278): n is a, c, g, or t
  modified_base (472)..(488): a, c, t, g, unknown or other
  misc_feature (472)..(488): n is a, c, g, or t
tcagcatagtagtgcacgaccggtgctcgatttagtgatagagcgtaacaacagagggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtccatttccngccatcatggctcagctgaagatgaggctgattactactgccagtcgtatcgacaccaagctagaaacgtttgggcttcgggcggaggaccaggctgaccgtctacgtcacgcccaaggctcgccccgtcgtccactctcgttcccgccctcctccactactatcgctgacggcggctcggcacggcgcatagnnnnnnnnnnnnnnnnn

SEQ ID NO: 19338 - DNA, 481 bp, Homo sapiens
  misc_feature: GYAE6OF02FIYRO.10.40.D07.1.454.CMB.1.raw
  modified_base (305)..(305): a, c, t, g, unknown or other
  misc_feature (305)..(305): n is a, c, g, or t
  modified_base (470)..(481): a, c, t, g, unknown or other
  misc_feature (470)..(481): n is a, c, g, or t
tcagcatagtagtgcacgaccggtgctcgatttagtgatagagcgtaacaacagaggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagntgagctgattacactgccagtcgtatgacacaagctgaaactttgggcttcggcggagggaccaggctgaccgtcctacgtcacgcccaaggctcgccccgtcgtccactctcgttcccaccctcctccactactactgctgagcggctggcacggcacgatagnnnnnnnnnnnn

SEQ ID NO: 19339 - DNA, 504 bp, Homo sapiens
  misc_feature: GYAE6OF02JJRMV.10.40.D07.1.454.CMB.1.raw
  modified_base (373)..(373): a, c, t, g, unknown or other
  misc_feature (373)..(373): n is a, c, g, or t
  modified_base (486)..(486): a, c, t, g, unknown or other
  misc_feature (486)..(486): n is a, c, g, or t
  modified_base (488)..(489): a, c, t, g, unknown or other
  misc_feature (488)..(489): n is a, c, g, or t
  modified_base (491)..(504): a, c, t, g, unknown or other
  misc_feature (491)..(504): n is a, c, g, or t
tcagcatagtagtgcacgaccggtgctcgatttagtgatagagcgtaacaacagagggggggggtggagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtccatttcctggccatcaatgggctccaggctagaagatgaggctgtattactactgccagtcgtatgaccacagctagtaacttggtctcgggcggaggaccnggtctacggaccgttcctacgtcacgcccaaggcctcgccccgtcggtcctactctcgttccccgccttcctcctactctactcgctagcgtccggctcggacgagcgcatancnncnnnnnnnnnnnnnn

SEQ ID NO: 19340 - DNA, 532 bp, Homo sapiens
  misc_feature: GYAE6OF02JZGFD.10.40.D07.1.454.CMB.1.raw
  modified_base (278)..(278): a, c, t, g, unknown or other
  misc_feature (278)..(278): n is a, c, g, or t
  modified_base (515)..(532): a, c, t, g, unknown or other
  misc_feature (515)..(532): n is a, c, g, or t
tcagcatagtagtgcacgaccggtgctcgatttagtgatagagcgtaacaacagaggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttccnggccatcaatcgggctccaggctgaagtatgaggctgacttactactgcctagtcgtatgaccaccaagtctagtaaacgtttgggtaccttcgggcggtagggacctagggcctacgtacccgtcctacgtcacgcccgaaggcctccgcccctcggtcacgtctccgtcccacccttcctaccactactactcgcgtcgacggccgggtgtcggtacgacggtcgacgagtacgnnnnnnnnnnnnnnnnnn

SEQ ID NO: 19341 - DNA, 711 bp, Homo sapiens
  misc_feature: GYAE6OF02JH2DF.10.40.D07.1.454.CMB.1.raw
  modified_base (261)..(261): a, c, t, g, unknown or other
  misc_feature (261)..(261): n is a, c, g, or t
  modified_base (630)..(630): a, c, t, g, unknown or other
  misc_feature (630)..(630): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
  modified_base (696)..(697): a, c, t, g, unknown or other
  misc_feature (696)..(697): n is a, c, g, or t
  modified_base (700)..(700): a, c, t, g, unknown or other
  misc_feature (700)..(700): n is a, c, g, or t
  modified_base (702)..(702): a, c, t, g, unknown or other
  misc_feature (702)..(702): n is a, c, g, or t
  modified_base (705)..(711): a, c, t, g, unknown or other
  misc_feature (705)..(711): n is a, c, g, or t
tcagcatagtagtgcacgaccggtgctcgatttagtgatagagcgtaacaacagaggggggggtgagggatgagaacctatgaacattctgtaggggtcaccatctcctgcactgggaacaacttcaacatcggggcagcttacgatgtccactggtatcgcctaacttccaggcacacgcccccaaaatccgtcttctatgtgacttcaatcggccctgacgggtcctgaccgcttcgtcgtcggcctttacaacgttcnggccacgttatcgaacaccgttcccattttccgaggccactcgaaagttcggggccttaccggtacggtcctaggaacgtacgttcggaacggtcttaggaactttacctacgtcggaccaaggtccggttaatccggaacttaaccggaaagtccgttagtaaaccggttttacgggttccgttacggggtccggaaagggtaccctaaacgggtccttaccgggtaacccgttcccgttaccggttacacccgggaaccccgtaaacggggtccctacccggttaccccccgtttcggtaccgtaacccttcggtttacccgtttccccaaccccccggttttcccaacccttacctacgtttaacncgttccgttaggacccggtccgggtacgtcgggaccaaccggggcctaggaaccttagnctncgcnntcncngcnnnnnnn

SEQ ID NO: 19342 - DNA, 683 bp, Homo sapiens
  misc_feature: GYAE6OF02FUHCS.10.40.D07.1.454.CMB.1.raw
  modified_base (304)..(304): a, c, t, g, unknown or other
  misc_feature (304)..(304): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (671)..(671): a, c, t, g, unknown or other
  misc_feature (671)..(671): n is a, c, g, or t
  modified_base (677)..(679): a, c, t, g, unknown or other
  misc_feature (677)..(679): n is a, c, g, or t
  modified_base (682)..(682): a, c, t, g, unknown or other
  misc_feature (682)..(682): n is a, c, g, or t
tcagcatagtagtgcacgaccggtgctcgatttagtgatagagcgtaacaacagagggggggggtgagggatgagaacctatgaacattctgtaggggtcaccatctcctgcactgggaacaacttcaacatcggggcagcttacgatgtccactggtatcgccaacttccaggcacacgacccccaaaatcgtacttctatggtgacttcaatcggccctagaggggtccctgaccgtcttctctggcttcaagtctggcacgtaggacacgtcccatttccgtggccatcaatgggctaccnggtcaggaacgatggaggctagtacgtttaactactcggacctggtacgttaagtcgtaaccaaccgaacgtcgtaacgttaaaccgtttgggttacctttacgggacggggtaacgggaacccggtacggacgttccggtaacccgtccgtttaaccggtctaacccgggaaccctaaagggccttaaccccggtcccccgttacggttcccctaaaccgttccgtttacccgggttacccccgacccctttcccgtacccgttaaccgttaacctacgtcgttaccgtaggtacccggcggggtcctacggggtaccaacggggtcctacggtaatcggcgacncgtnacgtgntacgcncncgncgtacnnncgnc

SEQ ID NO: 19343 - DNA, 324 bp, Homo sapiens
  misc_feature: GYAE6OF01EI874.25.6.A06.1.454.CMB.1.raw
  modified_base (321)..(324): a, c, t, g, unknown or other
  misc_feature (321)..(324): n is a, c, g, or t
tcagactgtacagtcacgaccggtgctcgatttagatctactgacaacacacagggcactgatttatggtgcaactaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgcccctcggtcactctgttcccgcctcctcactgtacagtctgagcgggctggcaaggcgcatagnnnn

SEQ ID NO: 19344 - DNA, 327 bp, Homo sapiens
  misc_feature: GYAE6OF01CMMK2.25.6.A06.1.454.CMB.1.raw
  modified_base (324)..(327): a, c, t, g, unknown or other
  misc_feature (324)..(327): n is a, c, g, or t
tcagactgtacagtcacgaccggtgctcgatttagatctactgacaacacacagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctcggtcactctgttcccgccctcctcactgtacagtctgagcgggctggcaaggcgcatagnnnn

SEQ ID NO: 19345 - DNA, 200 bp, Homo sapiens
  misc_feature: GYAE6OF01C67HH.25.6.A06.1.454.CMB.1.raw
  modified_base (181)..(200): a, c, t, g, unknown or other
  misc_feature (181)..(200): n is a, c, g, or t
tcagactgtacagtcacgaccggtgctcgatttagatctactgacaacacacgaagggcccatccggtcttcccctggcgccctgctccaggagcacctccgagagcacagcggcctgggctgcctggtcaaggactacttccactgtactagtctgagcgggtctggcaaggcgcatagnnnnnnnnnnnnnnnnnnnn

SEQ ID NO: 19346 - DNA, 450 bp, Homo sapiens
  misc_feature: GYAE6OF01EIQJX.25.6.A06.1.454.CMB.1.raw
  modified_base (88)..(88): a, c, t, g, unknown or other
  misc_feature (88)..(88): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (391)..(450): a, c, t, g, unknown or other
  misc_feature (391)..(450): n is a, c, g, or t
tcagactgtacagtcacgaccggtgctcgattttagatctactgacaacacacagggcactgatttatgggtgcaaactaaaaaaacnctcttggaccccctgcccggttctcaggctccctccgttgggggcaaagctgccctgacactgtcagatgtgcagcctgaggacgaggctagactaccactgcctgcctctccgtcgtgggtggtcgcgttggggttcgttcgggcggaacgggaacccaaacgtcggacccgtccgtgggtcacggccccaaggtcctccgccccctcggtacctacgtcctccgttcccccaccctccactactacgtacncgttctggacggcgggtctacgggcgaacgggccgactacgtagntcgcnnnnnnnnnnnnnnnnnnnnnnnnnnnnnnnnnnnnnnnnnnnnnnnnnnnnnnnnnnnn

SEQ ID NO: 19347 - DNA, 484 bp, Homo sapiens
  misc_feature: GYAE6OF01CB6TT.25.6.A06.1.454.CMB.1.raw
  modified_base (86)..(86): a, c, t, g, unknown or other
  misc_feature (86)..(86): n is a, c, g, or t
  modified_base (367)..(367): a, c, t, g, unknown or other
  misc_feature (367)..(367): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (422)..(424): a, c, t, g, unknown or other
  misc_feature (422)..(424): n is a, c, g, or t
  modified_base (426)..(484): a, c, t, g, unknown or other
  misc_feature (426)..(484): n is a, c, g, or t
tcagactgtacagtcacgaccggtgctcgatttagatctactgacaacacacagggcactgatttatggtgcaaactaaaaaaacnctcttggaccccctgcccggttctcaggcctccctccgttggggggacaaagctgccatgacactgtcagtatgtgcagccgtggaagggacgaggtctcgacctaccacttgcccttgccttcctcctcgtgggtggtgtcgttggggtcgtcgggacgggaaggacctaacgtcgtacccggtcgtggggtaccacggacccgacggcctccggtccccccgtcggtcctaccggtcttcccggttcccccacccttccgtaccacgttcggtaaccgngttcgtcgggacggtccgggcgtacggggcaaacggggcctagtaancgngtgcnnncnnnnnnnnnnnnnnnnnnnnnnnnnnnnnnnnnnnnnnnnnnnnnnnnnnnnnnnnnnn

SEQ ID NO: 19348 - DNA, 215 bp, Homo sapiens
  misc_feature: GYAE6OF02H0LMN.25.6.A06.1.454.CMB.1.raw
  modified_base (179)..(215): a, c, t, g, unknown or other
  misc_feature (179)..(215): n is a, c, g, or t
tcagactgtacagtcacgaccggtgctcgatttagatctactgacaacgacacaagggcccatcggtcttcccctggcgccctgctccaggagcacctcccgagagcacagcggccctgggctgcctggtcaaggctacttccactgtacagtctgagcgggctggcaaggcgcatagnnnnnnnnnnnnnnnnnnnnnnnnnnnnnnnnnnnnn

SEQ ID NO: 19349 - DNA, 324 bp, Homo sapiens
  misc_feature: GYAE6OF02GS6SV.25.6.A06.1.454.CMB.1.raw
  modified_base (314)..(314): a, c, t, g, unknown or other
  misc_feature (314)..(314): n is a, c, g, or t
  modified_base (320)..(324): a, c, t, g, unknown or other
  misc_feature (320)..(324): n is a, c, g, or t
tcagactgtacagtcacgaccggtgctcgatttagatctactgacaacacacagggcactgatttatggtgcaactaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttcccgcctcctcactgtacagtctgagcgggctggcaaggcncatagnnnnn

SEQ ID NO: 19350 - DNA, 328 bp, Homo sapiens
  misc_feature: GYAE6OF02H2GIB.25.6.A06.1.454.CMB.1.raw
  modified_base (321)..(328): a, c, t, g, unknown or other
  misc_feature (321)..(328): n is a, c, g, or t
tcagactgtacagtcacgaccggtgctcgatttagatctactgacaacacacagggcactgatttatggtgcaactaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctcggtcactctgttcccgcctcctcactgtacagtctgagcgggctggcaaggcgcatagnnnnnnnn

SEQ ID NO: 19351 - DNA, 437 bp, Homo sapiens
  misc_feature: GYAE6OF02IQBE6.25.6.A06.1.454.CMB.1.raw
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (422)..(437): a, c, t, g, unknown or other
  misc_feature (422)..(437): n is a, c, g, or t
tcagactgtacagtcacgaccggtgctcgatttagatctactgacaacacacaggcactgatttatggtgcaactaaaaacactacttaggacccctgcccggttctccacggctccctccttggggcaaagctgccctgacactgtcagatgtgcagcctgaggacgaggctgactaccactgcctgctctcctctggtggtgctttgggtcgttcggacggagggaccaaacgtggaccgtcctggggtcacggtacccgaagggtcctcggccccccgttcgggtaccaccgttccgttccggttcccccgtacccctccccgttcaacccgttcgtaaccgcgggttccttcgggaacggtccggggccttcggccgaaaccgggtccggctaacgtggntcgntcgaancngctncnnnnnnnnnnnnnnnn

SEQ ID NO: 19352 - DNA, 328 bp, Homo sapiens
  misc_feature: GYAE6OF02FMMAA.25.6.A06.1.454.CMB.1.raw
  modified_base (320)..(328): a, c, t, g, unknown or other
  misc_feature (320)..(328): n is a, c, g, or t
tcagactgtacagtcacgaccggtgctcgatttagatctactgacaacacacagggcactgatttatggtgcaactaaaaaacactcttggacccctgcccggttctcaggctccctccttggggcaaagctgccctgacactgtcagatgtgcagcctgaggacgaggctgactaccactgcctgctctcctctggtggtgcttgggtgttcggcggagggaccaaactgaccgtctgggtcagcccaaggctgccccctggtcactctgttcccaccctcctcactgtacagtctgagcggctggcaaggcgcatagnnnnnnnnn

SEQ ID NO: 19353 - DNA, 326 bp, Homo sapiens
  misc_feature: GYAE6OF02HAN9N.25.6.A06.1.454.CMB.1.raw
  modified_base (317)..(317): a, c, t, g, unknown or other
  misc_feature (317)..(317): n is a, c, g, or t
  modified_base (323)..(326): a, c, t, g, unknown or other
  misc_feature (323)..(326): n is a, c, g, or t
tcagactgtacagtcacgaccggtgctcgatttagatctactgacaacacacagggcactgatttatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctcgttcccgccctctcactgtacagtctgagcgggctggcaaggcncatagnnnn

SEQ ID NO: 19354 - DNA, 400 bp, Homo sapiens
  misc_feature: GYAE6OF02F6CI9.25.6.A06.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (342)..(343): a, c, t, g, unknown or other
  misc_feature (342)..(343): n is a, c, g, or t
  modified_base (347)..(347): a, c, t, g, unknown or other
  misc_feature (347)..(347): n is a, c, g, or t
  modified_base (351)..(400): a, c, t, g, unknown or other
  misc_feature (351)..(400): n is a, c, g, or t
tcagactgtacagtcacgaccggtgctcgatttagatctactgacaacacacagggcactgatttatggtgcaaactaaaaaaacactcttggacccctgccccggttctcaggctccctccttgggggcaaagctgccctgacactgtcagatgtgcaggcctgaggacgaggctgactaccatgcctgctcncctntggtgtgcttgggtgttcggcggaggaccaaactcgacccgtcgtggtcagcccaagccncgcccctcggtcactcctcgtccccgcctcctcactcgtactagttccgngacggccggcgtcggacgaacggccgataatagnncgtnactnnnnnnnnnnnnnnnnnnnnnnnnnnnnnnnnnnnnnnnnnnnnnnnnnn

SEQ ID NO: 19355 - DNA, 683 bp, Homo sapiens
  misc_feature: GYAE6OF01EGG1X.45.82.H05.1.454.CMB.1.raw
  modified_base (245)..(245): a, c, t, g, unknown or other
  misc_feature (245)..(245): n is a, c, g, or t
tcagacgcgatcgacacgaccggtgctcgatttagtcgagctctctcgcggggtctgagagaggagccttagccctggattccaaggcctatccacttggtgatcagcactgagcaccgaggattcaccatggaactggggctcctctgggttttccttgctggtattctagaaggtgtccagtgcgaggtgcaattggtggagtcgtgggggaggcctgggtcaagccgtgggggtccctgacnctctcctgtgtagcctctggcttcttctttccgacgccctccaccatgaacgtcgggtcccgccgacgggccgtacccggggggaaggggacgtgggacggttcgggtttcgccgtaactccgaacgttccgggcacgccgaacgttcgggcgtttacgacctaccttattactacgttcggtcaggtcggtcggggtactacgttttaccacgtttccaaggacgacgaaacccgtaccaaaggtaacgaaccgtacgtcgtttacccgtgaaccgtaaagtcgggaacggggtcctagggtaaggacgtaccgggaaggaccggtacggtacctcgttactttacggttttgcgtacgagggaagggtataaagtggacgtggttacccggcccacggtacgacccggtaaggaaccccgtggtcccgtaccccgg

SEQ ID NO: 19356 - DNA, 775 bp, Homo sapiens
  misc_feature: GYAE6OF01EHPC6.45.82.H05.1.454.CMB.1.raw
  modified_base (262)..(262): a, c, t, g, unknown or other
  misc_feature (262)..(262): n is a, c, g, or t
tcagacgcgatcgacacgaccggtgctcgatttagtcgagctctctcgcggggtctgagagaggagccttagccctggattccaaggcctatccacttggtgatcagcactgagcaccgaggattcaccatggaactggggctcctcttgggttttccttgctggtattctagaaggtgtccagtgcgaggtgcaattggtggagtcgtgggggaggcctggtcaagccgtgggggtccctgacactctcctgtgtagcctntggcttctctttcgaccgccctccaccatgaacgtcgggtcccgccgaggccgtaccggggggaagggcgtgggaggttcggttccgctactccagtccggacagctacgtgggtcgttacgaacctaccttaatttaccgtagtttccggtactaggtcgggtccggggttactaacttttaacccgtaacttttaccgaaaggtaacgaaccgaaaccgacccgaaaaggaacgtaaacctaccgttcgtttccctagaacgtaaacgtgggtacggggtacctagggaacggtacgggtaccgggaacggaccgtaccgggttccttaccgtttaccgttttacggtttttcgggtcggttaaccggtaaagggggtaaagggggttaaagttaaaacggttagggaaacggttaccgggtttacccccgggaccccgttaaccgaacccgggtaaccccgggaaacccgggggttaacccccgttgggtaaccccgttaaccccccggg

SEQ ID NO: 19357 - DNA, 715 bp, Homo sapiens
  misc_feature: GYAE6OF01DVQS3.45.82.H05.1.454.CMB.1.raw
  modified_base (269)..(269): a, c, t, g, unknown or other
  misc_feature (269)..(269): n is a, c, g, or t
tcagacgcgatcgacacgaccggtgctcgatttagtcgagctctctcgcggggtctgagagaggagccttagccctggattccaaggcctatccacttggtgatcagcactgagcaccgaggattcaccatggaactggggctcctcttgggttttccttgctggtattctagaaggtgtcagtgcgaggtgtaattggtggagtcgtgggggagtcctggtcaacggccgtcggggggtccctgaccacttcctctggtgtacgcctntcggtctttctctttccgaccgtccctccaccatcgaaccgttcgggtcccgccgaggccggtaccgggggaagggtacgtgggtacggtcggttccggctacgtccgtagtccggcaacgccgtacgtcggtcgtttacgaaccctaacctttattaacgttaacggtttccggtgacgggttcgggtcgggggttacttaacttttacccgtaactttccgaaggaacgaaccgtaaccgaccgtaaaagaacgtaacctagttcgttacctagacctaaagtggacgggtaccgtaggaacgtcggtaacggacggacctaccgggtcttccttacgtttactttggtacgtagaagggaggtaactaagtacggtaggtcgttccggacccctgaaccgtcccggaaaccggttacccgtcggttccctacccggttcccgg

SEQ ID NO: 19358 - DNA, 648 bp, Homo sapiens
  misc_feature: GYAE6OF01EH3XF.45.82.H05.1.454.CMB.1.raw
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
tcagacgcgatcgacacgaccggtgctcgatttagtcgagctctctcgcggggtctgagagaggagccttagccctggattccaaggcctatccacttggtgatcagcactgagcaccgaggattcaccatggaactgggctcctctgggttttccttgctggtattctagaaggtgtccagtgcgaggtgcaattggtggagtcgtggggagcctggtcaagccgtgggggtccctgacactctcctgtgtagcctctgcttcttctttcgacgcctccaccatcgacgtcgggtccncgaggcgtaccggggaaggtcgtggagtggtcncatccatcggcacgcacgtggacgttgaccacctattactagttcggtcaggtggccgggtctactttaccagtttccagactacgaacgaccgaaagaagaacactcgttcctagaactaaagtcggaacggggtcccttaggagtacggtacggaacggaccgaaccggtcttacccgtttacgtttaccgttttcggtaggtaccgtacgggtaaggggtaactaaaggtaccggtaaggtccggttacccggtaccccggactaccgggacccgtaaaccggggttaccccgttacgggtccctaacccggg

SEQ ID NO: 19359 - DNA, 705 bp, Homo sapiens
  misc_feature: GYAE6OF02GPKMZ.45.82.H05.1.454.CMB.1.raw
  modified_base (244)..(244): a, c, t, g, unknown or other
  misc_feature (244)..(244): n is a, c, g, or t
tcagacgcgatcgacacgaccggtgctcgatttagtcgagctctctcgcggggtctgagagaggagccttagccccggattccaaggcctatccacttggtgatcagcactgagcaccgaggattcaccatggaactggggctcctctgggttttccttgctggtattctagaaggtgtccagtgcgaggtgcaattggtggagtcgtgggggaggccgtggtcaagccgtgggggtcctgacnctctcctgtgtagcctcgtggtcttcctcgtttccgaccgccctccaccatcgaacgttcgggtcccgccgagggtccggtccgggggaacggacgtgggacggttcggttcgctactcccgtagtcgggaccacggccgtacggtcgggtccggttacgaaccctaaccttaagtttaccgtacgtttcggtacgtacgggttcgggtcggggtttacgtaacttttaacccgtaccttttaccgaaggtaacggaaccgtaaacccggtaaccgaaaggaacaaaccttaccgttcgttacccgtagtaaccgtaaagtcgggaccgggtccaggacggtacgtacggaacggaccgtaccggtcttacctttacgtttacgttttgtacgtgagggtaggtaataggtagagtcgttaccgccgacgacgaccggaacgtccggtcggtcctcgtccg

SEQ ID NO: 19360 - DNA, 712 bp, Homo sapiens
  misc_feature: GYAE6OF02HA8RJ.45.82.H05.1.454.CMB.1.raw
  modified_base (563)..(563): a, c, t, g, unknown or other
  misc_feature (563)..(563): n is a, c, g, or t
tcagacgcgatcgacacgaccggtgctcgatttagtcgagctctctcgcggggtctgagagaggagccttagccctggattccaaggcctatccacttggtgatcagcactgagcaccgaggattcaccatggaactgggctcctcttggttttcctgctgtattctagaggtgtccagtgcgaggtgtaattgggtggagtcgtgggggacggcctggtcaagccggtcgggggtccctgacactctcctgtgtagcctcgtggtcttcttctttcgaccgtcctccacctatgaacgtcggtcccgccgacggcggtaccggggaagggtccgtgggacggttggttccgcactccacgtccggcacgctacgtggtacggttagacctaaccgttatttacgtagttccgggtctagggttacgggtccggggttacgtttaacgttttaacccgttactttacccgaaggacgtaaaccgaaaccgtccgaaaagaacgtaaacccgtacgtttcggttaccctaggttaccgaaagtcgggaggggtcctaggaacgnggtacggaaggaccgtcgtaccttcttacgtttagttttgtacggtacgagggtagggttaactaaaggttacggacgttaaccggttcccggacccgtacgacccggtacggaaccggttaaccccgtggtacccgtacccgttcccg

SEQ ID NO: 19361 - DNA, 818 bp, Homo sapiens
  misc_feature: GYAE6OF02JQ20K.45.82.H05.1.454.CMB.1.raw
tcagacgcgatcgacacgaccggtgctcgatttagtcgagctctctcgcggggtctgagagaggagccttagccctggattccaaggcctatccacttggtgatcagcatgagcaccgaggacttcaccataggaacgtggggcctcctcgttgggtttttccttgcgttggttactttcgtaaggtaaggtcgtaccaggtcggacggtaggtgtactaagtttgggtggtacggttcggtggggggacggccgttggtacaacggtccggtcgggggtccctgactccttcttcctaggtcgtacgtccgtgtcggttcttccttcgttccgaaccgtcccctaccgaccagtccggtaacggtcggtcccgacccgtacgggtccggtacggggaaggtaccgtgggtaggttcggttcgacctacgtaccgacgtaccggacgtacgtaccgtagtcggttacgttaccgaaccttccttaagttccgtacggtttccggtagtacgggtcgggtacggggtactttaacgttccttacgttaccgaacggtaccgaacgtaaccgaacgtaaaggtaactaactccggttcgttaaccgtcgtaaacgtaagggtccggagggcgtaccggtaagtagggtaacggacgggtaccgtaccggttcgttaccgtttacgtttaccgtttcggtacgtaccgggtagggtaaaccggttaagtaaacgaagggttaaccggtaccgggttccggacccgttacggaacgggttcccggaaacccgggtttcccgtacgggttccccttaacccgg

SEQ ID NO: 19362 - DNA, 585 bp, Homo sapiens
  misc_feature: GYAE6OF01DIQBF.14.64.F09.1.454.CMB.1.raw
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgcttattaaattggtatcagacaaaaaccagggaaanccctaactcctgatctttgatgcatcaatttgcagagtgggtcccatcacgcttcactggcagtggctcgtgggacagtatttcacttctacaccatcagtccgtctccaactgaaagtatttgactaacttactactgtacaacagtagttatgtactaccccggtggtaaccgttccgggaccgtaaggggaaccctaaggggtcgggaagaacttacgaaaaaccggtattacgggttacgggaccttacggacctaacccgtattccgttaggtttaccctttaccaacctttccccgttacccccggtaccc

SEQ ID NO: 19363 - DNA, 539 bp, Homo sapiens
  misc_feature: GYAE6OF01COG81.14.64.F09.1.454.CMB.1.raw
  modified_base (230)..(230): a, c, t, g, unknown or other
  misc_feature (230)..(230): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgcctatttaaattggtatcagacaaaaaccagggaaagccctaacctcctgatctttgatgcatccaatttgcagagtggggtcccatcacgcttcactggcagtggctcgtggacagtatttcactctcacatcagcgtctccaactgaagtatttgactaacttactactgtacaacagtagttatcgacttaccccggtaggtaccgttccggccgaacggggtaccgaagggtcgggaagacgtacgaaaaccggacgtacggtggactagccaccattcctgttacttcacttccttcccgcc

SEQ ID NO: 19364 - DNA, 679 bp, Homo sapiens
  misc_feature: GYAE6OF01DPKAC.14.64.F09.1.454.CMB.1.raw
  modified_base (270)..(270): a, c, t, g, unknown or other
  misc_feature (270)..(270): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagtcgttatcgcttaatttaaattggtatcagacaaaaacgaggaacnccctaactcctgattctttgatgcatccaatttgacagaggtcgggtcccatcacgcttcacgtggcaggtggctcgtgggactagtactttcacttctaccaacctatccgacggtcccggttacctaccccgtaaaccttaggtaaacgttactttttacgaaccttaaaccttttaaccttaaccgttacgttaacctaaacgtaaggttaacgttttaacgtacggtaaccgttaacccccgggttagggttaacccggtttaccgggaaccgtaacggggttaacccgtaaggggttacgggaacgtaacgtaaccgtaaaacggtaacgttgggtacgggtacctacggtaccctacctagttccgttacgttacctttaccactttcccgttccccgtaccg

SEQ ID NO: 19365 - DNA, 536 bp, Homo sapiens
  misc_feature: GYAE6OF01CGIZN.14.64.F09.1.454.CMB.1.raw
  modified_base (230)..(230): a, c, t, g, unknown or other
  misc_feature (230)..(230): n is a, c, g, or t
  modified_base (428)..(428): a, c, t, g, unknown or other
  misc_feature (428)..(428): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtccgcatctgtaggagacagagtcaccatcacttgccggacaagtcagagcgttancgcctatttaaattggtatcagacaaaaaccagggaaacgcccctaacctcctgatctttgatgcatccaatttgcagagtcgggtcccatcacgcttcactggcagtggctcgtgggacagtatttcactctcaccatcagcgtctcaacctgaagtattttgactaactttactactagtacaaactagtagttangtaacctaccccggtaggaccgttcggaccgtaaggggaccaagggtggagactacgaaacgtactggtcggctgacaccatcttgtcttcacttccttcccgctacg

SEQ ID NO: 19366 - DNA, 612 bp, Homo sapiens
  misc_feature: GYAE6OF01CM2AI.14.64.F09.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgctatttaaatgtatcagacaaaaaccgaggaaacnccctaactctgactcttgatgcatcctaatttgacaggagtcgggtcccatcacgtcttcactggcaggtcggctcgtggacagtactttcactctcaccatcagtcggtcctaccaactagaagtatttcgactaacttactactgtacaacgtagtaagttactcgtaacgttaccccggtagggtacccgtttccgggaccggtaacggggaaccctaaggggtcggaaggtaacttaaccgaaaacggtaaccggttggtacgggtaccgtacggaccctaacccgtacgttaccgttacggtttacccttactaacccgtttcccgttacccccggtacc

SEQ ID NO: 19367 - DNA, 676 bp, Homo sapiens
  misc_feature: GYAE6OF01BMUSE.14.64.F09.1.454.CMB.1.raw
  modified_base (273)..(273): a, c, t, g, unknown or other
  misc_feature (273)..(273): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaaaccagggaaacnccctaacctcctgatctttgatgcatccaatttgcaggagtgggtcccatcacgcttcactggcagtggctcgtgggacagtactttcacttctaccacctatcacggtccggttcctacccgaaccttggtaaacgttagtttttacgaaccttaaacctttaccttaacgttcgtaccaaacgtagtaagtttatacgtaacgttaacccccggttagggtaacccggtttccgggacccggaagggggtaaccctaaggggttacgggaaacgtaacgttaaccgaaaaaccggtaaacgttgggtaccgggtaccgttacggaccccgtaaacccgttacgttacccgtttacggttacccgtttaacctaaccgtttccccgtttcccccgtaacccg

SEQ ID NO: 19368 - DNA, 545 bp, Homo sapiens
  misc_feature: GYAE6OF01AFE8Q.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcagaagccagggaaagcccctaaacttctgatctatgatgcaaccaatttacaagatgggatcccatcaaggttcagtggcggtggatcgtggggcgtatttcactctcaccatcagcagtctgcaacctgaagtatttgcgtacttacgtggtgtacaacgtagggttactacgtaacttaacccgtactacgttttcgggaccgtacggggtaccaaggtcgtaggactagtactagtaacgtaacgtggtacggtctacgccacctacttcgtatcgttctacttccccg

SEQ ID NO: 19369 - DNA, 596 bp, Homo sapiens
  misc_feature: GYAE6OF01DM68N.14.64.F09.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtctccatcctccctgtctgcatctgtaggagacagagtcaccatcacttgccggacaagtcagagcgttancgcttaatttaaattggtatcagacaaaaaccgagggaaacnccctaactctgattctttgatgcatcctaatttgcagagtcgggtcccatcacgcttcacgtggcagtggctcgtagggactagtatttcactctcacatcagcgtcaccaactgaagttntttgactaacttactactntacaactaggtattatcgtaacgttaccccggtagggtaccggtttccgggaccgtaacgggggtaaccctaaggggttacggaacgtaacgtaaccgaaaaccggtacgttaggtcgggtactacggacctaaccgtattcccgttagttacccttacgtactttccccgttccccgtaccg

SEQ ID NO: 19370 - DNA, 514 bp, Homo sapiens
  misc_feature: GYAE6OF01CZUPB.14.64.F09.1.454.CMB.1.raw
  modified_base (230)..(230): a, c, t, g, unknown or other
  misc_feature (230)..(230): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgcatatttaaattggtatcagacaaaaacagggaaacgccctaacctcctgatctttgatgcatccaatttgcagagtgggtccatcacgcttcactggcagtgctcgtgggacagtatttcactctcacatcagcgtctaccaactgaagtatttcgactaacttactactgtacaatagtattatgaactacccggtggtaccgttcggaccgagggaccaggtgaagactacgaaacgtacgtggtagctcgacacngtctgtcttcncttccgtacccg

SEQ ID NO: 19371 - DNA, 572 bp, Homo sapiens
  misc_feature: GYAE6OF01DKB3R.14.64.F09.1.454.CMB.1.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
  modified_base (538)..(538): a, c, t, g, unknown or other
  misc_feature (538)..(538): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttatttaaattggtatcagacaaaaaccagggaaacnccctaacctcctgatctttgatgcatcctaatttgcagnggtcgggtcccatcacgcttcactggcagtggctcgtggacagtacttcactctcaccatcacgtccgtcctaccaaccgtgaagttatttcgactaacttactactcgtacaactagtatttatacgtacgttaccccggtgggtaccggtttccgggaccgaacgggggaccaagggtcggaagtaacgtaccgaaaacgtacgtggtacggctaggaccaacctntccgttcgttaccttctacttcccgttcccgacc

SEQ ID NO: 19372 - DNA, 562 bp, Homo sapiens
  misc_feature: GYAE6OF01CY035.14.64.F09.1.454.CMB.1.raw
  modified_base (270)..(270): a, c, t, g, unknown or other
  misc_feature (270)..(270): n is a, c, g, or t
  modified_base (437)..(437): a, c, t, g, unknown or other
  misc_feature (437)..(437): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacnccctaactcctgatctttgatgcatccaatttgcagagtcgggtcccatcacgcttcactggcagtggctcgtgggactagtactttcactctcaccatccgagccggttctaccaacctgaacgttattttgacctaactttactactgtacaacagtacgtttancgtaactaccccggtggaccgttcggaccgtagggacctaagggtggagactaccgaaaacgacttgggtacgcgttcgcctaacccgtagtccgttgttcccttacaccgttccgttccccgac

SEQ ID NO: 19373 - DNA, 685 bp, Homo sapiens
  misc_feature: GYAE6OF01BGFDX.14.64.F09.1.454.CMB.1.raw
  modified_base (271)..(271): a, c, t, g, unknown or other
  misc_feature (271)..(271): n is a, c, g, or t
  modified_base (385)..(385): a, c, t, g, unknown or other
  misc_feature (385)..(385): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagtcgttatcgacttaatttaaatggtatcagacaaaaacgaggaaacnccctaactctgatcttgatgctatccaatttgctaggtagtcgggtcccatcacgcttcacgtcggcaggtggcttcgtagggactaggtaactttccgacttactcaaacctntccgaacggtccggttaccttacccaaaccgtagtaaacgttacttttacggaccttaaactttaccgtaacttacggtaactaaaccgtaaggttaacgtttaagtacgtaaccgtaacccccgggttcgggtaaccggtttccgggaacccgggtaaaccggggttaaccgaacggggttacgggaacgtaaacgttaaccggaaaacgttaaacggtcggttacgggtacgtacggacccttaaccggtactacgtttacggtccttttaacgacctttacccgttcccccggtaac

SEQ ID NO: 19374 - DNA, 519 bp, Homo sapiens
  misc_feature: GYAE6OF01AKMT4.14.64.F09.1.454.CMB.1.raw
  modified_base (504)..(504): a, c, t, g, unknown or other
  misc_feature (504)..(504): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagccctaaacctcctgatctttgatgcatccaatttgcagagtggggtcccatcacgcttcactggcagtggctcgtgggacagtatttcacttctcaccatcagcggtctccaacctgaagtattttgctaacttactactgtacaacagtagttatgactaccccggtggacgttcggccgagggaccaagggtggagatacaaacgactggtcggctgcaccattctcgttcttnacttccttcccgtac

SEQ ID NO: 19375 - DNA, 625 bp, Homo sapiens
  misc_feature: GYAE6OF01DPTVP.14.64.F09.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (403)..(403): a, c, t, g, unknown or other
  misc_feature (403)..(403): n is a, c, g, or t
tcagcgtctagtaccacgaccggtgctcgatttagcgcgtatacaagggggagtcaggtctcagtcaggacacagcatggacatgagggtccccgctcagctcctggggctcctgctactctggctccgaggtgccagatgtgacaccagttgacccagtctccatcctccctgtctgctatctgtaggagacagagtcaccatcacttgccgganaagtcagagtcgttatcgcttatttaaatggtatcagacaaaaaccgagggaacnccctaactcctagactctttgatcgctataccaatttgactagacggtcgggtcccatcacgcttcacgtggcagtcggctcgtggacagtactttcactctacacctatcagcgtctaccaacgtgaattntttcgactaacttactatcgtacaactagtaagttagtcgtaacgttaccccggtaggttacccgggttccgggaaccggtaacgggggtaacccgtaaggggttacggaacggtaacgttaaccggaaacgggtaacgttacgggtcggaccttacggaccctaccgttacgttcgttccgttaccgtttacctaacccgtttcccgttaccccgtacccg

SEQ ID NO: 19376 - DNA, 577 bp, Homo sapiens
  misc_feature: GYAE6OF01BVDFN.14.64.F09.1.454.CMB.1.raw
  modified_base (270)..(270): a, c, t, g, unknown or other
  misc_feature (270)..(270): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttatttaaattggtatcagacaaaaacgaggaaacnccctaactctgatcttgatgcatccaatttgcagagtcgggtcccatcacgtcttcacgtgactagtcgctcgtgggactagtactttcacttctacacatcacgtccgtctacctaacgtgtaagtatttcgactaacttactactgtacaacgtagtaagttactacgtacgtacccgtggtaccgttcgggacccggaaggggtaaccctaagggtacggaacgtaacgtaccgaaaacggtacgtggtacgcgtacggaccacgtacgtcgttacgtaccttactacttcccgttcccgtacc

SEQ ID NO: 19377 - DNA, 679 bp, Homo sapiens
  misc_feature: GYAE6OF01EJ7N0.14.64.F09.1.454.CMB.1.raw
  modified_base (271)..(271): a, c, t, g, unknown or other
  misc_feature (271)..(271): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgaccttatttaaattggtatcagacaaaaaccaggaaacnccctaactcctgatcttgatgcatccaatttgacaggagtcgggtcccatcacgtctcactggcagtggctcgtgggactagtactttcactctcacctatcacgtccgttaccctaccaaccttagtaaacgttacttttacgaccttaaacctttacgttaacctcgttacctaaacctaaggtaacgttttaacgtacgtaaccgttacccccgggtagggttaacccggttcccggggacccggtaaacgggggtaccccgtaaaggggttacgggaacgtaaaccgtaaccggtaaaaccggtaacggttacgggtcgggtacccgttacggacccaaccgttaccgttacgtttaccgttacccgtttaccctaaccgtttccccctttccccggtaacccg

SEQ ID NO: 19378 - DNA, 591 bp, Homo sapiens
  misc_feature: GYAE6OF01BX20Y.14.64.F09.1.454.CMB.1.raw
  modified_base (230)..(230): a, c, t, g, unknown or other
  misc_feature (230)..(230): n is a, c, g, or t
  modified_base (266)..(266): a, c, t, g, unknown or other
  misc_feature (266)..(266): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgctaatttaaattgtatcagacaaaaacaggaacnccctaactctgatcttgatgctatccaatttgacagagtgggtcccatcacgtcttcacgtggcagtggctgtgggacagtactttcacttctaccacgtatcgacgtccggttctaccgaacctgtaacgtattttcgaacctaactttactagttcgtacaaacgtagtaacgtttatacggtaaccttaccccggtaggtacccggttcgggaccgtaacgggggaacctaagggtcggaagtaactaacgaaaacgtacgtggtcggtcgtacgctaccgtacttccgttcgttaccttactcttcccgtttccccgaccc

SEQ ID NO: 19379 - DNA, 701 bp, Homo sapiens
  misc_feature: GYAE6OF01DFJNW.14.64.F09.1.454.CMB.1.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (412)..(412): a, c, t, g, unknown or other
  misc_feature (412)..(412): n is a, c, g, or t
tcagcgtctagtaccacgaccggtgctcgatttagcgcgtatacaaaggggagtcagtctcagtcaggacacagcatggacatgagggtccccgctcagctccgtggggctcctgctactctggctccggaggtgccagatgtgacacccagttgacccagtctccatccctccctgtctgcatctgtaggagacagagtcaccatcacttcgccgganaagtcagagtcgttatccgtacttaattttaaagttggtaactcaagaacaaaaaacgagggaaaccncccctaacctcctagtattctttagactgactactcctaatttcgacgtaggtacggtcgggtacccagtccgacgtcttacacgtggctagtcggctcgtggactagtactttcactctacacntcagtcgtccaccaactgaattatttacgactaacttactactacgtacaagtagtattactacgtaccgttccccgggtaggtacccggttaccggggaccggtaacgggggtaaccgtaaggggtacgtaacggtaaccgttaaaccggaaaaacccggttacggttacggggttccggaaccgttacccggtaacccgtaaacccgtttaccgtttacccggttttaccggtttaccccttttaaccgttaccccgttttaccccgtttaccccccggtaacccgg

SEQ ID NO: 19380 - DNA, 537 bp, Homo sapiens
  misc_feature: GYAE6OF01EV0BF.14.64.F09.1.454.CMB.1.raw
  modified_base (271)..(271): a, c, t, g, unknown or other
  misc_feature (271)..(271): n is a, c, g, or t
  modified_base (494)..(494): a, c, t, g, unknown or other
  misc_feature (494)..(494): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccgagggaaacnccctaactcctgatctttgatgcatccaatttgcagtagtcgggtcccatcacgtcttcactggcaggtgctcgtggacagtatttcactctcacatcagccgtcaccaactgaatatttgactaacttatactgtacaagtagtagttatcgaaccttccccggtaggtaccgttcggaccgtaaggggacaagggtgaagatacgaaacgtactggtacgntgacacctattccgtcgttacttaccacttcccgtcccgtacg

SEQ ID NO: 19381 - DNA, 553 bp, Homo sapiens
  misc_feature: GYAE6OF01C37YP.14.64.F09.1.454.CMB.1.raw
  modified_base (398)..(398): a, c, t, g, unknown or other
  misc_feature (398)..(398): n is a, c, g, or t
  modified_base (434)..(434): a, c, t, g, unknown or other
  misc_feature (434)..(434): n is a, c, g, or t
  modified_base (494)..(494): a, c, t, g, unknown or other
  misc_feature (494)..(494): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcttaatttaaattggtatcagacaaaaaaccgagggaaacgccctaacctcctgattctttgatgcatccaatttgcagagtcgggtacccagtcacgcttcacgtggcagtggctcgtggactagtactttcactctcacatcagtcgtctaccaactgaacgtntttcgactaacttactactgtacaacgtagtattancgtaactacccggtggaccgttcggaccgagggaccaagggtgaagactacgaaaacgtntcggtcgactcgaccaccgtattccgttcgttacttacccacttcccgttcccgtaccg

SEQ ID NO: 19382 - DNA, 716 bp, Homo sapiens
  misc_feature: GYAE6OF01CKI5P.14.64.F09.1.454.CMB.1.raw
  modified_base (280)..(280): a, c, t, g, unknown or other
  misc_feature (280)..(280): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtcctccatccctccctgtctgcatctgtaggagacagagtcaccatcacttgccggacaagtcagacgtcgttatccgccttaatttaaattggtatcaagacaaaaaccgagggaaacnccctaacctctgtattcttgatcgctactcctaattgacaggtaggtcgggtcccatcgacgtcttacacgtggactaggtcggcttcggtaggacagttactttaccacttcctaccacctactcgaacgggtccggttaccctacccgtaaccgtaggtaaacgtttattttacggaaccttaaccgttttacctaacgttacgtaacctaaacgtaggtttaacgtttaacgtaccggtaaccgttaccccccgggttagggttaaccccgggtttacccgggaacccggggttaaacgggggaacccgtaaaggggttacgggaacggtaaccgtaaccggaaaaccggttaacgtgggtaccggtaccgtacggaccctaacctagttcccgttacgttcccttaccgttacttccccgttacccccgacg

SEQ ID NO: 19383 - DNA, 579 bp, Homo sapiens
  misc_feature: GYAE6OF01EH77E.14.64.F09.1.454.CMB.1.raw
  modified_base (215)..(215): a, c, t, g, unknown or other
  misc_feature (215)..(215): n is a, c, g, or t
  modified_base (347)..(347): a, c, t, g, unknown or other
  misc_feature (347)..(347): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttatcgcctattaaattggtatcagacaaaaaccagggaaacgccctaacctcctagatctttgatgcatccaatttgacaggagtcggggtcccatcacgcttcactggcagtggctcgngggacagtatttcactctacacctatcagccgttacaccaaccgtagaagtattttcgacctaaacgtttactacttcgtacaacgtagtaagtttatacgtacgtacccccggtaggaccggtttcgggaccgtaacggggaccgtaagggtacggagaactaccgaaacgtacgtggtcgcgtacgcctaacctagttcctggttacctacctacttcccgtccgtaccc

SEQ ID NO: 19384 - DNA, 757 bp, Homo sapiens
  misc_feature: GYAE6OF01DAP0T.14.64.F09.1.454.CMB.1.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
tcagcgtctagtaccacgaccggtgctcgatttagcgcgtatacaagggggagtcagtctcagtcaggacacagcatggacatgagggtccccgctcagctccgtggggctcctgctactctggctccggaggtgccagatgtgaccacccagttcgacccagtctccatccctccctgtctgcatctgtagganacagagtcaccatcacgttggaccggaacaagtcgagagtcgttatccgtacttaagtttaaattggtaactacaacgaaaccgaaaaaaccgaggggaaaaccncccctaaaccgtcctagtattccttttagactacgtctaacttacctaatttcggactaggtacgggtccggtacccattccgacgtctacgtacgtggctaggtcggacttcgagggaactagtacttttaccaccttacgtacctaacctacgtccgtaacggtacccgttacctaaccccgtaacgttaggtaaacggtttactttttaaccgaaccctttaaactttaacccgttaacgttaccgttaactaaacgtacggtttaagttaacgtaccgtaacccggttaccccggttagggtaccggttacccgggacgaaaccggggtaacctaaggggtacggaacaacgttaaaccggaaaacggtacgttacgggttaccggacgttacgacccgtaccttagttccttaccggttacttacccgttaacttcccgttccccgtaaccg

SEQ ID NO: 19385 - DNA, 503 bp, Homo sapiens
  misc_feature: GYAE6OF01BGQB8.14.64.F09.1.454.CMB.1.raw
  modified_base (260)..(260): a, c, t, g, unknown or other
  misc_feature (260)..(260): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (486)..(486): a, c, t, g, unknown or other
  misc_feature (486)..(486): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaatggtatcagcaaaaaccngggaaagccctaactcctgatctttgatgcatccaatttgcagagtggggtcccatcacgcttcactggcagtggctctgggacagatttcactctnaccatcagcggtntccaactgaanattttgcaaacttactactgtcaaacagagttatgataccccgtggaccgttgccagggacaaggtcggagagtcaaaacgaactagtagctgcaccatctagtnttcatcttcccgtaccc

SEQ ID NO: 19386 - DNA, 533 bp, Homo sapiens
  misc_feature: GYAE6OF01DN55T.14.64.F09.1.454.CMB.1.raw
  modified_base (215)..(215): a, c, t, g, unknown or other
  misc_feature (215)..(215): n is a, c, g, or t
  modified_base (388)..(388): a, c, t, g, unknown or other
  misc_feature (388)..(388): n is a, c, g, or t
  modified_base (474)..(474): a, c, t, g, unknown or other
  misc_feature (474)..(474): n is a, c, g, or t
  modified_base (519)..(519): a, c, t, g, unknown or other
  misc_feature (519)..(519): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagtcgttatcgcctatttaaattggtatcagacaaaaaccaggaaacgccctaactcctgatctttgatgcatccaatttgcagagtgggtcccatcacgcttcacgtgcagtggctcgtggacagtatttcactctacactatcagccgtctaccaactgaagtntttgactaactttactactgtaccaagagtattatcgtaacttccccgtaggtaccgttcgggccgaagggacctaaggtcggaanactacgaaaacgtatggtcgatcgactacattccgtgttaccttnacttcctcccgtac

SEQ ID NO: 19387 - DNA, 576 bp, Homo sapiens
  misc_feature: GYAE6OF01D6B6Q.14.64.F09.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttancgacttaatttaaattggtatcagacaaaacgaggaaacnccctaactctgattcttgatgctatcctaatttgacaggtagtcgggtcccatcacgtctcacgtggcgtagtcggctcgngggactagtatttaccncttctcacatcagtccgtctaccaactgtaattcttgactaattactactntacaatgtattagtacgacgtacccgtgggtaccgtcgggaccgaacgggtaccgaaagggtcggagtaaccgtacgtaaaaccgtagttcgggtacggtactacggacctaccgagttacgttcggttaccttcgtaccttcccgttcccgtaacc

SEQ ID NO: 19388 - DNA, 646 bp, Homo sapiens
  misc_feature: GYAE6OF01EHKZ6.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtctccatcctccctgtctgcatctgtaggagacagagtcaccatcacttgccggacaagtcagagtcgttatcgtaccttatttaaattggtatcagacaaaaaccgaggaacgaccctaacctcctgtattctttgatgctatacctaatttgcaggtaggtcgggtcccatcacgtcttacacgtggctaggtcggctcgtagggaactagtactttccacctctaccacctagtcgacggtccggtacctaccgtaaccttggtaaacgttcttttacgaaccttaaccgtttacttaacgttcgtacaacgtaggttagttactacgtaaccgttaccccggttagggtaccggttacccgggaccggtaacggggtaaccgtaagggtacggaacgtaacgtaacgaaaacggtaacgttcggtcggtactacgacctaccgtagttcttcgttacttacctactttcccgtcccgtaccg

SEQ ID NO: 19389 - DNA, 644 bp, Homo sapiens
  misc_feature: GYAE6OF01A12Y1.14.64.F09.1.454.CMB.1.raw
  modified_base (190)..(190): a, c, t, g, unknown or other
  misc_feature (190)..(190): n is a, c, g, or t
  modified_base (352)..(352): a, c, t, g, unknown or other
  misc_feature (352)..(352): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacttgccggacaagtcagagtcgttatcgcctatttaaattggtatcagacaaaaacagggaaacgccctaacctcctgatctttgatgcataccaatttgctagagtgggtcccatcacgtctcacgtggcagtggctcgtgggacngtacttcactctcacatcgagtccggtcctacctacgtagtaacgttactttacgaccttaacttactacgttacgtaccaaagtacgttaagttactacggtaaccgttacccggtacgggtaccggttaccgggaccgggtaacggggtaacccgtaaggggtacggtaaacgtactaaccggtaaaaccgtaaacggttcgggtacggttacccgtacggtaacccctaccgtaacgttccgtttcgttacctttacccgtacccgttttcccgttacccccggtaccc

SEQ ID NO: 19390 - DNA, 734 bp, Homo sapiens
  misc_feature: GYAE6OF01C4CA5.14.64.F09.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
tcagcgtctagtaccacgaccggtgctcgatttagcgcgtatacaagggggagtcagtctcagtcaggacacagcatggacatgagggtccccgctcagctccgtggggctcctgctactctggctccgaggtgccagatgtgacacccagttcgacccagtcctccatccctccctgtctgcattctggtaggagacagagtccaccatcacttgccggaanaagtcagagtcgttancgtacttaatttaaagttggtatacagaacaaaaaacgagggaaacctaccctaacctccgtagattctttagaactcgactactacctaatttcgacgtaggacggttcgggtacccagtaccacgtacttcaccgtggacaggttcggcttcgtagggacctaggtactttcgacttcctacacctactacgtacggtccgtccctaaccgtaaccgtaggtaaactttacgttttacgaaccttaaacctttacgtacgtttacgtaacctaaacgttaaggtttaacgttaaccgttacggtaacccgttaaccccggggttacgggttaacccggtttccggggaaccgggtaaccgggggaaaccgttaaagggttcggggaaattaccgtaaaaccggaaacgtaacgttacgggtacggtactaccggtaacctaacccgttagttcgttaccgtttactacctacccgttcccgttcccggtaacc

SEQ ID NO: 19391 - DNA, 659 bp, Homo sapiens
  misc_feature: GYAE6OF01AD4AO.14.64.F09.1.454.CMB.1.raw
  modified_base (272)..(272): a, c, t, g, unknown or other
  misc_feature (272)..(272): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaaccagggaaacnccctaacctctgatctttgatgcatcctaatttgcagaggtcgggtcccatcacgcttacacgtggcagtggctcgtggacagtatttcactctcacctatcagcgtcctaccaactgaattatttcgactaactttacctacttcgtacaactagtagtttatacgtacttaccccggtgggtaacccggttccgggacccggtaacgggggtaacccgtaaggggtacgggaacgtaaccgtaaccggtaaaaaaccggtaaccggttacggggttacgggtacccgttacgggtaaccccgtaaccccgtttaacgtttcccggtttaccggttttacccctttaaccttacccgttttccccccgtttccccccggtaacccg

SEQ ID NO: 19392 - DNA, 704 bp, Homo sapiens
  misc_feature: GYAE6OF01APVKJ.14.64.F09.1.454.CMB.1.raw
  modified_base (269)..(269): a, c, t, g, unknown or other
  misc_feature (269)..(269): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttatttaaattggtatcagacaaaaacgaggaacnccctaactcctgatctttgatgcatacctaatttcgctagtagtcgggtcccatccacgtcttcacgtggcagtggctcgtcgggactagtactttcacttcctcgacctatacgacggtccggttaccctacccgtaaccgttagaaagttacgtttttacggaaccttaaacctttaccttaacgttacgtaaccgtaaaacctaaggttaacgtttaagtaccggtaacccgtttacccccgggttacggggtaacccggtttacccgggtacccgggtaaaccgggggtaacccggtaacggggttagggaacgtaacgttaaccgaaaaccggtaaccgttgggttaccggacccggttacgaccccgtaaccgtaggtttcccttacggttaccctttaaccgtaccttttccccgttccccggtaacc

SEQ ID NO: 19393 - DNA, 682 bp, Homo sapiens
  misc_feature: GYAE6OF01E0JQR.14.64.F09.1.454.CMB.1.raw
  modified_base (650)..(650): a, c, t, g, unknown or other
  misc_feature (650)..(650): n is a, c, g, or t
  modified_base (674)..(674): a, c, t, g, unknown or other
  misc_feature (674)..(674): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttcgacccagtctccatccctcctgtctgcatctgtaggagacagagtcaccatcacttcgaccggacaagtcagagtcgttatcgtacttaatttaagttggtatcagaaccaaaaaccgaggggaaaccacccctaactcctagtacttctttagatcgactacttacctaatttcggacgaacggtacgggttccggggtaccccattcccgaccggtccttacaccgttggacctagggtcggtcgttcggtagggactagttactttccgaccttcctaccactacgtcgtaacggccgttacctaccgaacgttagaacgtttactttacgaaccttaaactttacgtacctaggtaaccaataagttaacgttagaccgtaccgtaccccgggtaggtaacccggttccgggaaccgggtaacggggaaccgtaagggtagggaacgtaacgtaaccgaaacggtagttacgggtcgacgtcgaacctacctntcgttcgtaccttactccttcccncccgtacc

SEQ ID NO: 19394 - DNA, 540 bp, Homo sapiens
  misc_feature: GYAE6OF01DE8E2.14.64.F09.1.454.CMB.1.raw
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (394)..(394): a, c, t, g, unknown or other
  misc_feature (394)..(394): n is a, c, g, or t
  modified_base (472)..(472): a, c, t, g, unknown or other
  misc_feature (472)..(472): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgaccggacaagtcagagcgttancgcttatttaaattggtatcagacaaaaacgaggaacnccctaactctnatctttnatgcatcctaatttgcagaggtcgggtcccatccacgtcttcacgtggcaggtggctcgtgggactagtatttcactctacactatcagtcgtctaccactgaagtntttacgacttaacttactactgtaccaatagtattatgaactacccgtggtacgttcggcgtaggggacagggtgaanatacgaaacgcgtggcgtactcggccaaccgtattcgtacttacgttcctacgttcccttccccgtac

SEQ ID NO: 19395 - DNA, 622 bp, Homo sapiens
  misc_feature: GYAE6OF01CV7H8.14.64.F09.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (423)..(423): a, c, t, g, unknown or other
  misc_feature (423)..(423): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttcgacccagtctccatccctccctgtctgcatctgtaggagacagagtcaccatcacttgaccgganaagtcagagcgttancgacttatttaaattggtatacaagacaaaaaccgagggaaacncccctaactcctagattctttgatcgactatacctaagtttgacgaggtacggtcgggtacccatcgacgcttcacgttcggactaggtcggctgtagggactagtacttcactctacacatcgagccgtcaccgtaactgaattntttacgactaactttcacttagtacaaactgtaacgttatacgtacgtacccggtaggtaccggttccgggacgtaacggggaaccgtaaggggttacgaacgtaacgttaaccggaaaaacgttcgtacggtggtacctacggacctaccgttaattccgttacgttaccttactacccgttccgtttaccccggacc

SEQ ID NO: 19396 - DNA, 562 bp, Homo sapiens
  misc_feature: GYAE6OF01CFLYL.14.64.F09.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
  modified_base (341)..(341): a, c, t, g, unknown or other
  misc_feature (341)..(341): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgccttatttaaattggtatcagacaaaaaccagggaaacnccctaactcctgatcttgatgcatccaatttgcagagtgggtcccatcacgcttcacgtggcagtggctntgggacagatttcactctcacatcagcgtctaccactgaatatttgactaacttactactgtacaactagtagtttataggtacttaccccggtaggtaccgttcgggaccgtaggggaaccctaagggtggaagtaactaaccgaaacgtaacgtcggtaggcctacggccaccctagttccttcggttaccctttaccactttccccgttccccgtacc

SEQ ID NO: 19397 - DNA, 575 bp, Homo sapiens
  misc_feature: GYAE6OF01A33VE.14.64.F09.1.454.CMB.1.raw
  modified_base (215)..(215): a, c, t, g, unknown or other
  misc_feature (215)..(215): n is a, c, g, or t
  modified_base (433)..(433): a, c, t, g, unknown or other
  misc_feature (433)..(433): n is a, c, g, or t
  modified_base (556)..(556): a, c, t, g, unknown or other
  misc_feature (556)..(556): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttatcgccttaatttaatggtatcagacaaaaaccagggaaacgccctaacctcctgatctttgatgactatccaatttgcagtaggtcgggtcccatcacgcttcactggcagtggctcgtggacagtactttcacttctaccacctatctacggcggtcctaccaacctgaaagtattttcgactaaccttactactgtaccaanagttagtatgtaacttcccggtggtaccggttccgacggtaacggggtaccaagggttaggaacgtacgtaccgaaaacgtacgtggtacggactggaccacctactcgttcggtcctttacnctttcccgtccccgtaccg

SEQ ID NO: 19398 - DNA, 702 bp, Homo sapiens
  misc_feature: GYAE6OF01A9MWQ.14.64.F09.1.454.CMB.1.raw
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggactccgaggtgccagatgtgacacccagttgacccagtctccatccctccctgtctgcatctgtaggagacagacgtcaccatcacgttgccggacaagtcagagcgttancgtcttatttaatggtatcagaccaaaaaccgagggaacnccctaacctcctgtactctttgatcgactactcctaatttgacaggtacggtcggggtcccatccgacgtccttcacgtggctaggtcgcctcgtacgggactagtactttccaccgttccgtaccacctagttaccgacggtcccggttaccctaccgtaaccgttgaaacgtttacttttcggaaccttaaacctttaccgtacgttacgtaacctaaacgtacggttaacgtttacgaccgtaccgttaaccccgggttagggtacccggtttacccgggaccgggtaaccggggtaaccgtaaggggttacggaaggtaaccgttaacccgtaaaaccggtaacgttcgggtacggtccttacggcccttaaccgtcgttaccgttcgtttaccctactacccgttccccgttaccccgtaccg

SEQ ID NO: 19399 - DNA, 582 bp, Homo sapiens
  misc_feature: GYAE6OF01CKE23.14.64.F09.1.454.CMB.1.raw
  modified_base (486)..(486): a, c, t, g, unknown or other
  misc_feature (486)..(486): n is a, c, g, or t
  modified_base (526)..(526): a, c, t, g, unknown or other
  misc_feature (526)..(526): n is a, c, g, or t
  modified_base (556)..(556): a, c, t, g, unknown or other
  misc_feature (556)..(556): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccggaggtgccagatgtgacacccagttgacccagtctccatcctccctgtctgcatctgtaggagacagagtccaccatcacttgaccggacaagtcagagtcgttatcgcttaatttaaattggtatacagaaccaaaaaccgagggaaaccaccctaacctcctagattcttagatgactatacctaatttcgactaggtacggttcggggtaccccaatccgacgtccttacgacgtggctaggtcggctcggtgggaactagttacttcactctaccacctatcgacgtccgtacctaccaacgttagaacgttatttcgaaccttaactttactactgtacaacgtagtattanacgtacgtcccggtggtaccgtcggacgagggactagggngacgagtacgaagtagtggtgctgctactntcttctacttactcttccgtcccgac

SEQ ID NO: 19400 - DNA, 719 bp, Homo sapiens
  misc_feature: GYAE6OF01AYD6Z.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagtcgttatcgcttaatttaaattggtatcaagacaaaaccgagggaaacgaccctaacctcctgatctttgatgcactcctaatttgacaggtacggtcggggtcccagtaccgaccgtcttaccacgttcggcgtaggtcggcgtcgtcgggactacggtattttaccacgttctaccacctataccgtacgtccggttaccctacccgtaaacccgttagtaaacgttacgtttttacggaacctttaaaccgtttaacttaaccgttacgtaaccgtaaacgtacgttaacgtttaacgtacgtaaccgttaaccccggttagggtaacccggttccgggacccggtaacgggggtaaccgtaaggggtacgggtaacggtaactaaccggtaaaaaccggtaacggttacgggtacgggtacctacggtacctaacccgtagttcccgttacgtttaccttaccgttaacccttcccgttccccgtaacccg

SEQ ID NO: 19401 - DNA, 565 bp, Homo sapiens
  misc_feature: GYAE6OF01DYZAY.14.64.F09.1.454.CMB.1.raw
  modified_base (266)..(266): a, c, t, g, unknown or other
  misc_feature (266)..(266): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgctattaaattggtatcagcaaaaaccagggaaanccctaaactcctgatctttgatgcatccaatttgcagagtgggtcccatcacgctcactggcagtgctntgggacagntttcactctcacatcagcgtctccaactgaagtattttgactaactttactaactcgtacaacagtaagttatcgaacttaaccccgtgggtaccgtttcgggaccgtaagggggaccctaaaggggttggaagtaagtacgaaaaaccggtaacttaggttcggactgggtacccaaccgtaattcctggttcccttacaacttcccgttccccggaccc

SEQ ID NO: 19402 - DNA, 706 bp, Homo sapiens
  misc_feature: GYAE6OF01DG7R3.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacgttgaccggacaagtcagagtcgttatcgtacttaattttaaagttggtatacagaacaaaaaccgagggaaacctccctaacctctagtattcgtttagatcgactactacctaagtttcgacgtaggtacgggtccgggtacccataccgaccgtcttacgaccgtggacgtaggttgcttacgtagggaactagttactttaccaccttcgtaccacctagtacgacgtccgtacctacctaacgttagaacgtttactttacgaccttaactttaccgtacttagtaaccctaaagtacggttaacgttagtaccggtaaccgttcccgggttagggtacccggtttacccggggaaccggtaaccggggaaccgtaacgggttagggaacgttaacgtaaccggtaaaccgtacgttcgggtacgtaccgttacgaccctaccgtagtttacccttcggttacccctttaggtacccttcccgtccccgtaaccg

SEQ ID NO: 19403 - DNA, 560 bp, Homo sapiens
  misc_feature: GYAE6OF01ACJC2.14.64.F09.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (526)..(526): a, c, t, g, unknown or other
  misc_feature (526)..(526): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttatcgcctatttaaatggtatcagcaaaacnggaanccctaactctgatctttgatgcatccaatttgcagagtgggtcccatcacgtctcacgtggcaggtcgctcgtggactagtacttcactcncactntcgacgtcgtcaccgaactgtaacgtatttcgacttaacttactacgtcgtaaccaagtagtagttatacgtaaccgttcccggtacggtaccggttccggacggaacgggtaccgaagggtagaacgtagtaaccgaaacgtacgtcggtcgacgtcgcctacctnttcgttacgttcttacgtcttcccgtcccgtacc

SEQ ID NO: 19404 - DNA, 572 bp, Homo sapiens
  misc_feature: GYAE6OF01DJC35.14.64.F09.1.454.CMB.1.raw
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
  modified_base (402)..(402): a, c, t, g, unknown or other
  misc_feature (402)..(402): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtccaccatcacttgccgganaagtcagagcgttatcgcttaatttaaattggtatcagacaaaaaccgagggaaacnccctaactcctgatctttgatgctatccaatttgctaggagtcgggtcccatcacgtctcactggcagtgctcgtgggacagtacttcactctacaccatcgacgtccgtcctaccaactgaacgttntttacgacctaacttactactacgtacaactagtagttactgtactacccggtggaccgtttccgggacggtaacgggacctaagggtggaacgtacgtaaccgaaacgtacgtggtcggctacggcctaactcgttactcgttaccttactacgttcccttcccgaccg

SEQ ID NO: 19405 - DNA, 689 bp, Homo sapiens
  misc_feature: GYAE6OF01CCW6F.14.64.F09.1.454.CMB.1.raw
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
tcagcgtctagtaccacgaccggtgctcgatttagcgcgtatacaagggggagtcgaggtctcagtcaggacacagcatggacatgagggtccccgctcagctcctggggctcctgctactctggctccgaggtgccagatgtgactacccagttcgaccctagtctccatccctcctgtctgcatctgtaggagacgaggagtcaccatcacgttgccgganaagtcagagtcgttatcgacttatttaatgtatctagacaaaaacgnggaaactccctaactcagacttctttcgaattgactaagtcctaaatttcggacgtaggacggttcgggtaccctattccgacgccttacaaccgtggctaagggttggcttcggagggaactaggttactttacacctttcacacctagtccacggtccggtactaccgaacttagaaacgtttacttttagaaccttaacgtttaacctacgttataaccgtaaacttaagtaacggttactacgtaacccgttccccgggtaggtaacccggtttcgggacccggttaaggggacccttaagggtacggaactacggtaaaccgaaaacggtagtgggttaccggtctacggaccctaaccgtagtttccgttaccggttaccttaccttaacgtcccccgggttaacctaacccg

SEQ ID NO: 19406 - DNA, 882 bp, Homo sapiens
  misc_feature: GYAE6OF01DUEVI.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctcgaggtgccagatgtgacacccagttgacccagtctccatccctcctgtctgcatctgtaggagacagagtccaccatcacgttcgaccggaacaagtcgagacgtcgtttatccgacctttaattttaaagtttggttaattaccgaacgaaacctaaaaaaacccggaaacggggtaaaaccctacccccttaaacccgttaccctagtaacctttccgtttagtacgttacgacctaacttacccgttaaagtttcgacgtaaggtacgggttaccggggtacccctaacgttacccgtaccgtacctttaccgtaaccggttcgggtaaccgtaacgggttcggtaccgttaccggtacggggtaacctaacggtttacctttacctaccgtttaccctacctaaacccgtacgttacccgacgggtttcccgtaacccttacccccgtaaacgttaacggttaaacgtttacgttttaccgtaacctttaaacccgttttaaccgttagttaaccgttaaacccgtaaacgttaacggtttaacgtttaacgttacccggttaaccccgtttaaccccggggttacgggtttaacccgggttaccccggggaccgggttaaaccggggaaccggtaacggggttacggaaacggtaaccgtaaaccggtaaaacggtccggttaggtccgggtactaccggactacctaagttccgttacttactttccctacttcccggttacccctaccg

SEQ ID NO: 19407 - DNA, 726 bp, Homo sapiens
  misc_feature: GYAE6OF01D3NFZ.14.64.F09.1.454.CMB.1.raw
  modified_base (191)..(191): a, c, t, g, unknown or other
  misc_feature (191)..(191): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacttcgccggaacaagtcaggacgcgttatccgtaccttaatttaaagttggttatacagaaccaaaaaccgaagggaaacgaccctaaacctcctagtactctttgatgactatacctaatttacgcgaggtaggttcggggtaccctagtacacgtccttacacgtcggtactaggtacggcgttacggtgggaactaggtactttaccaccttccgtaccacctactacgacggtaccggttccctaaccgtaaccgttaggtaaacgtttacgtttacggtaacttaaacctttacgttaacgttacgttaacaacgtacggtaagtttacgtacggtaaccgttaaccccgggttagggttaccggtttccgggtaaccgggtaacggggtaacccgtaaggggtacggaacgtaacgttaaccgtaaaacggtacggttacggtacggtaccgttacgccctaaccgtcgttaccgttcgttaccttacgtacctttccccgtcccgttaacccg

SEQ ID NO: 19408 - DNA, 655 bp, Homo sapiens
  misc_feature: GYAE6OF01AJA16.14.64.F09.1.454.CMB.1.raw
  modified_base (190)..(190): a, c, t, g, unknown or other
  misc_feature (190)..(190): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacttgccggacaagtcagagcgttatcgccttatttaaattggtatcagacaaaaaccagggaaacgcccctaacctcctgatctttgatgcatcctaatttgcagaggtcggggtcccatcacgtcttcactggcaggtggctcgtgggacagtatttcacttctacaccatcacgtccggtctcctaacctgaagttattttcgaccttaacttactactacgtaccaaacgtagtagtttactacggtaaccgttaacccccggtagggtacccggtttccggggacccggtaacgggggaacccgtaacggggtaggaacggttaacgtaaccggtaaaaacccggtaacggttcgggttcgggtaccgttacgggacccctacccgttaagtttcccgttacggttaccctttaccgtacccgtttccccgtttccccgtaccccg

SEQ ID NO: 19409 - DNA, 677 bp, Homo sapiens
  misc_feature: GYAE6OF01B8ZEY.14.64.F09.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagtacgttancgcttaatttaaattggtatcaagaacaaaaccgaaggaaacaccctaactcctgacttcttgatgctataccaatttcgactaggacggttcgggtaccagtccgacgtcttacacgtggacaggttggacgttcgtcgggactagtactttcaaccttctaccgtaacctagtccgaacggtccggtacctacccgtaaaccgttagtaaacgttacgttttacgaaccttaaaccttaccgttaacgttacgttaccgtaaaacgtagttaacgttaacgttacgtaaccgttaaccccgggttacggtacccgggtttaccgggtaccggtaacgggggtaacctaaggggtaggtacgaaactaccgaaacggtaacgtggtcgacgtcgaccaccgtacgttacttacgttaccgttactcgttcccgtacccgtaccg

SEQ ID NO: 19410 - DNA, 694 bp, Homo sapiens
  misc_feature: GYAE6OF01AKC27.14.64.F09.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacttgccgganaagtcagagtcgttancgcctatttaatgtatcagcaaaacaggaacnccctaactcngatcttgatgcatccaatttgacagacggtcgggtcccagtcacggtcttacacgtcggaccagtggtcctcgtacgggactaggtacttttccgaaccttcttaccacctagtaccgtacggtccggttaccctacccgtaaaccgttcggtaaacgttaacgtttttacgaaccttaaaccgtttaaccttaaccgttcggttaacccaaagttaccggttaagttttaacgtaccggtaaaccgtttaccccccgggtagggtaacccggtttaccgggtaacccggtaacggggggtacccaaaggggttcggaacgttaacgtaccgtaaaacgtacgtacggtcgggtactacgtacccgaacccgtagttcccgttacgttaccttaccgtaaccgtttcccgttccccgaacg

SEQ ID NO: 19411 - DNA, 673 bp, Homo sapiens
  misc_feature: GYAE6OF01BCXJU.14.64.F09.1.454.CMB.1.raw
  modified_base (191)..(191): a, c, t, g, unknown or other
  misc_feature (191)..(191): n is a, c, g, or t
  modified_base (404)..(404): a, c, t, g, unknown or other
  misc_feature (404)..(404): n is a, c, g, or t
  modified_base (495)..(495): a, c, t, g, unknown or other
  misc_feature (495)..(495): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatccctccctgtctgcatctgtagganacagagtcaccatcacttgaccggactaagtcagagcgttatccgccttaatttaaattggtatacaagaacaaaaaccgagggaaacctccctaacctctgtattcttgatgctactacctaatttgactaggtaggttcgggtacccatcgacgtcctacacgtggcctaggtcgctgtggaactacgtatttccactccgtacaccgtanacgtacggtcccgttcctaacctaaccgttagtaaacgttaatttcgaaccttaacttacttacgttagtaccaaactaggtacgtttaanaccggtaaccttacccgggtacgggtaacggttacccgggaccgggtaaggggaacccgtaaggggtacgaacgaaacgttaccgaaaacggttacggtcggtacgggtaccgtacgtaacgacccttagttcccgttacgtttaccctacttaccgttccccgttccccgtaacccg

SEQ ID NO: 19412 - DNA, 837 bp, Homo sapiens
  misc_feature: GYAE6OF01CUEZE.14.64.F09.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttcgacccagtcctccactccctccctgtctgcatctgtaggagacagagtcaccatcacttcgccgganaagtcagagtcgttancgacttaatttaaatggtatacagacaaaaacgaggaaccaccctaactctgacttctttagatcgacacttacctaatttcggactaaggtacgggttacggggtacccctaagtaccgtaccgtccgtttacctaacgtcgggacctagggttcggtaccgttcggtacggggtaactaacggttacttttacccaacctttccctacctaaccctagttaccgtaacggtacccggtttacctaccccgtaaaccgttaggttaaacggtttactttttacggaacctttaaacccttttacgttaacccgttacgttaacccgtaaaaaccgttaggtttaacggtttaacgtaccggttaacccggtttaacccccgggttacggggtttaacccggttaacccggggtaccccggggtaaaggggggtaaaccccgtaaaggggggttcggaaaaccggttaacgttaaaaccccggaaaacgggttaccggttaaggtccgggtaaccgttacggtaaaccctaaccgttaacgtttcccgttaggttttacccctttactaacccgtttcccccggttaaccccgttacccg

SEQ ID NO: 19413 - DNA, 752 bp, Homo sapiens
  misc_feature: GYAE6OF01AROCO.14.64.F09.1.454.CMB.1.raw
  modified_base (240)..(240): a, c, t, g, unknown or other
  misc_feature (240)..(240): n is a, c, g, or t
  modified_base (737)..(737): a, c, t, g, unknown or other
  misc_feature (737)..(737): n is a, c, g, or t
  modified_base (746)..(746): a, c, t, g, unknown or other
  misc_feature (746)..(746): n is a, c, g, or t
tcagcgtctagtaccacgaccggtgctcgatttagcgcgtatacaagggggagtcgagtctcagtcaggacacagcatggacatgagggtcccgctcagctccgtggggctcctgctactctggctcggaggtgccagatgtgacacccagttggacccagtcctccactcctcctgtcctgactatcgtgtaggagacagagtccacatcacttcgaccggacagtcagagtccgttanccgtacttaagttttaagtcggtatacgaacgtaaccgaaaaaaccggaggggaaaacctcccccttaacgttaccgtagtaacttccgtttagacgttgaacctacgtcctaagtttcgacgtaacggtacggtccgggtaccactaccgtacgtcttaccggtaacgtcggtaccgtaaggtccggtaacgtcggtaaacgggtactaggtttaaacctttccgaacccttacgtacccgtaaaccgttacgttaccggaacggttccccggttaaccttaccccgtaaccgttaggtaaacgtttctttaacgtaccttaaacttacgtaactcgttaaccgtaaagtacgtaacgtttagacccgtaacgttaccccggtaggttacccggcggtaccggtaacggaacgttacggggacgtaacgttactaaccggaaacgttaacggtcgtagggttacctgacccgagtttacgacgttcgtacgttaanccggttccncgtacg

SEQ ID NO: 19414 - DNA, 845 bp, Homo sapiens
  misc_feature: GYAE6OF01BKBLX.14.64.F09.1.454.CMB.1.raw
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttcgacccagtctccatccctccctgtctgcatcgtggtaggagacagacgtccaccatcctacgttgcccgggaacaagtccaggacgtacgttatccgtaccttaattttaaagttggtaatacgaacgaaccaaaaaccgacggggaaaacctacccctaacctcctagtacttcttagatcgctatacctaatttggactaggtacggtcggggtacccctacgtacctacgtcttacgacgtggaccgtaggtcggccgtacggtacgggactaaggttacctttccaaccgttctacctaacccgtacgtaccgtacggtacccggttaccctaacccgtaacccgttaagggtaaacgttttaagttttacggtaaacccttaaaccgtttaaccttaacccgttacgttaaaccgtaaaacgttaacgggtttaaacgtttaaccgttaaccggaaacccgtttaccccccggggttaacggggttaacccgggtttaccccggggtaaccgggtaaccgggggtaaacccggtaaggggttaaccgggaacgttaaaccgggtaaccgtaaaacggtaaccggttagggtccggtaaccgttacggaccctaaacccggttcgttacccgtttacgtttacccggtaaccctttacccggtttcccccttacccccgggtaaacc

SEQ ID NO: 19415 - DNA, 527 bp, Homo sapiens
  misc_feature: GYAE6OF01B48IY.14.64.F09.1.454.CMB.1.raw
  modified_base (507)..(507): a, c, t, g, unknown or other
  misc_feature (507)..(507): n is a, c, g, or t
tcagcgtctagtaccacgaccggtgctcgatttagcgcgtatacaaggggggagtcagtctcagtcaggacacagcatggacatgagggtccccgctcagctcctgggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaaccagggaaacgccctaacctcctgatctttgatgcatccaatttgctagaggtgggtcccatcacgcttcactggctagtggctcgtgggacagtactttcactctcaccatcagtcgtcctacaacctgaatatttcgactaacttactactactacgaacagtattatagactacccgtggtacgttcggaccgagggacaagggtagagtactacgaaacgtatgtggctgcacctatctnttctctcttccgtcccgtcc

SEQ ID NO: 19416 - DNA, 698 bp, Homo sapiens
  misc_feature: GYAE6OF01DNPBC.14.64.F09.1.454.CMB.1.raw
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttcgacccagtctccatccctccctgtctgcatctggtaggagacagagtcaccatcacttcgaccggacaagtcagagcgttancgtacttaatttaaatggtatcagaacaaaaacgagggaaccnccctaactcctgattctttgatcgactacttacctaatttcgactaggtacggtcgggtaccccagtccacgtccttacgacgtggctaggtcggtctcgtacgggtactagttacttttaccaccttcctaccaacctataccgtacggtcccggttacctaacccgaaccgttagtaaacggttacttttacgaccttaaacttactacgtacgtaccaaacgtacgtagtttaacgtaccgtaaccgttaccccgggtacgggttaacccggtccggggtaacccggaaacgggggtaaccgtaagggttacggaaacgtaacgtaaccgaaaaccggtacgtacgggtacgcgttaccgccgtaccgtacgttaccgttcgtttacttaccgtcctttacccgttccccgtaccg

SEQ ID NO: 19417 - DNA, 656 bp, Homo sapiens
  misc_feature: GYAE6OF01CDT9L.14.64.F09.1.454.CMB.1.raw
  modified_base (360)..(360): a, c, t, g, unknown or other
  misc_feature (360)..(360): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatccctccctgtctgcatctggtaggagacagagtcaccatcacttgccgacaagtcagagtcgttatcgcttaatttaaagttggtatacagacaaaaaccgaggaaaccgaccctaacctcctgattcttgatcgactactcctaattgacgagacggtcgggtcccatccgacgtctactacgtggctaggnggtctacggtaggactaggttacttaccacgttccacacctacgtcgacggtccgtcctacctaacgtgtaacttatttcgaaccttaacgttctaacttacgaactaacgtaggttaattacgtacgtaacccgttacccggttacgggtacccggttacccgggaacgggtaaccggggtaacgtaacggggtcgaaagtaccgtaaacgaaacggtacgttaacgggcggtacgttacaccgtaaccgttcgttacgtcgtttacccttacctacctttccctaacccggtcc

SEQ ID NO: 19418 - DNA, 852 bp, Homo sapiens
  misc_feature: GYAE6OF01DELK9.14.64.F09.1.454.CMB.1.raw
tcagcgtctagtaccacgaccggtgctcgatttagcgcgtatacaaggggggagtcagtctcagtcaggacacagcatggacatgagggtccccgctcagctccgtggggctcctgctactctggctccggaggtgccagatgtgaccacccagttcgacccagtctccactccctccctgtctgctatctggtaggagacaggacgtaccacctatccacttcggacccggacaagtccaggtcgtaccgttaatccgtacttaagttttaaagttcggtaactacgaacggaacctaaaaaaaccggaggggtaaacccgtaccccgttaaacctccgttacggtaacttccgtttaagacgtttcgacctaattacccgtaagtttcggacgtacggtacgggttccgggtaccctagtccgtaacgttccttacgtaccggtcggtacgtacgggtcgggtcgttaccggtaggggtaacctagtttaccgttccgtaccttcgtaaccctaaccgcgttaaccggacggtacccgttccgtaaccctaaaccggttggtaaaaccgttttcgtttaacgtaaaccgtttaaccttttaaacccggtattaccggttaaaccgaaacgtttacgggttaacgtttaaccgtaacggtaaccccggtttaccccgggttagggttaacccgggttacccggaacgggttaaccggggtaaccgttaaggggggtaccaacgggttaaaccttaaccgggaaaccggttaacgttcgggttcggtaacctacgtaccgtaccccgtattcccgttagttacccctacgttactttcccccgtaccctacg

SEQ ID NO: 19419 - DNA, 712 bp, Homo sapiens
  misc_feature: GYAE6OF01D6G0C.14.64.F09.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
tcagcgtctagtaccacgaccggtgctcgatttagcgcgtatacaaggggagtcagtctcagtcaggacacagcatggacatgagggtccccgctcagctcctggggctcctgctactctggctccgaggtgccagatgtgacacccagttgacccagtctccatccctcctgtctgcatcgtgtagagacngagtcaccatcacttcgccggacaagtcagagcgttancgtacttattaaattggtatcagacaaaaccgaggaacnccctaaccnctgatctttgatgacgtacttacctaagtttcgacctaggtaacggttccggggttaccctaagtccgtaccgtaccgtttcgaacgttcggaccgttaacgggtggtccgttacgtacggggtaacctaggttacctttaccaacgtttcctacccgtaacctaacgttcgacgttaccggttcccttaacccgtaaaccgttacggtaaacgttcgttttaacggaacttaaaccgtttacgttactacgtaacgtaaactagtacggtttatacggtaactaccccggtaggttaccgttccgggaccgaacgggtaccgagggtagtacggtaactaacgtaaaaccgtagtacggttcggtaccttacgggcctaacccgtattacccgttacgttacccttacgtaacctttccgtccccggtaaccc

SEQ ID NO: 19420 - DNA, 760 bp, Homo sapiens
  misc_feature: GYAE6OF01EUR4L.14.64.F09.1.454.CMB.1.raw
  modified_base (272)..(272): a, c, t, g, unknown or other
  misc_feature (272)..(272): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtccaccatcacttcgccggacaagtcagagcgttatcgccttaatttaaagttggtatcagacaaaaccaggaacnccctaacctctgatctttgatgctattccaagttttcgacaggtacggttcgggtaccctatccgacgtcttaccacgttcggcgtagtggccgttcgtagggaacctaggtactttaccgaccttcctaccaccctactacgtacggtcccgttaccctaaccctaaccgttaggtaaacgtttacgttttaccgaacctttaacccgtttaaccgttaccttacggtaccctaaacgtaacgtttagtttaacgttcggtaacccgttaccccggttacgggttaacccgggtttcccgggaacccggggtaaccggggtaacccggaaacggggttcgggtaaaccggtaccgttaaaacccggaaaaccggttaacggttacgggttacgggtacccgttaccggacccgtaacccgttaacgttacccgttaccgttacctttacccgttacctttaacccccgttcccccggttaaaccccg

SEQ ID NO: 19421 - DNA, 751 bp, Homo sapiens
  misc_feature: GYAE6OF01DFLPC.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgaccggacaagtcagagcgttatcgtacttaatttaaattggtatacagaacaaaaaccgaggaaaccacccctaacctcctagtacttcgtttagatcgactacttaccgtaagtttcgacgaaggtacgggttcggggtacccaagtccgaccgtcttcacgtggactaggtcggctcgtagggactagtacttcgactctacactatcgacgtccggtacctaccgtaaccgtagtaaacgtttattttacgaacctttaacgtttacctacttacggtaacctaaacgtaaggtttaacgtttacgtaccggttaacccgttacccccgggttaggggttacccgggtttacccggggaccggtaacgggggtaacccgtaagggggtacggtaaacgtaacccgttaaaccggaaaaacccgggttcgttacgggtaccgggtaccgttaccggtaaccctaaaccccgttaggttaccctttaccggtttaccctttacccgttaaacccgtttcccccgttttacccccggaaccc

SEQ ID NO: 19422 - DNA, 701 bp, Homo sapiens
  misc_feature: GYAE6OF01DOUGQ.14.64.F09.1.454.CMB.1.raw
  modified_base (643)..(643): a, c, t, g, unknown or other
  misc_feature (643)..(643): n is a, c, g, or t
tcagcgtctagtaccacgaccggtgctcgatttagcgcgtatacaagggggagtcagtctcagtcaggacacagcatggacatggacgggtccccgctcagctccgtggggctcctgctactctggctccggaggtgccagatgtgaccaccagttcgacccagtctccactccctcctgtctgctatcgtggtaaggacacgtagacgtaccaacctataccacgttcggaccggtaataggtcgaaggagtccgttacgtcgtaacgttaatttaagtgtaactacaagaaaccaaaaacggacggtaaaccctaccctaacctctagtacttcgttagactgactactacctattcgacgtaggtacggttccgggtaccacgttaccgccgtaccgttacacggttcgacgtacgggtcggtccgtacgggtacggacgtacgttacttcaccgttctaccacgtactcggcgtaccgttacaccgtaagtagtaacttagttacgaacttaacgttactacgtacgtaaccgtaaatcggtaatttaccgagttacccggtccggttaggaccggttcgggaaccggaagggtacgtagggaagtacgtacgtaacgtaccggtaagtcggtcggtanaccgacctaccggtaatttccgtacgttacctaccttaccgttcccgttacccgtacg

SEQ ID NO: 19423 - DNA, 674 bp, Homo sapiens
  misc_feature: GYAE6OF01A4E1K.14.64.F09.1.454.CMB.1.raw
  modified_base (310)..(310): a, c, t, g, unknown or other
  misc_feature (310)..(310): n is a, c, g, or t
tcagcgtctagtaccacgaccggtgctcgatttagcgcgtatacaaggggggagtcagtctcagtcaggacacagcatggacatggagggtccccgctcagctccgtggggctcctgctactctggcctccggaggtgccagatgtgaccacccagttgaccccagtctccacttccctccctgtctgcctatctgtaggagacagagtccaaccatcctacgttcggaccggaactaagtccagtacgtcgttagtccgtacctttaatttaaagttggtatacgagaaccgaaaaaccgaggaaaccnccctaacctctagtacttcttagatcgtactaactccttaagtttgactaggtaggttcgggtacccagtccacgtcttacgacgtgactagtcggctcggagggactagtctttacgacttactacaccgtatcgaacgtccgtacctaccgtaaccgttaggttaacttacgtttacgaacttaaacctttcgtaacttcgtaaccaaggttaagtacgttagacgtacgtacccggttaggtcccggtacgaccggtaacgggaacctaaggggtacgaagtaacgtacgaaaccgtaggtacgtccgattcgaccgttactacgttcgttaccttactactaccgttcccgtcccgtacg

SEQ ID NO: 19424 - DNA, 638 bp, Homo sapiens
  misc_feature: GYAE6OF01DCPI2.14.64.F09.1.454.CMB.1.raw
  modified_base (95)..(95): a, c, t, g, unknown or other
  misc_feature (95)..(95): n is a, c, g, or t
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (389)..(389): a, c, t, g, unknown or other
  misc_feature (389)..(389): n is a, c, g, or t
tcagcgtctagtaccacgaccggtgctcgatttagcgcgtatacaagggggagtcagtctcagtcaggacacagcatggacatgagggtccccgntcagctcctggggctcctgctactctggctccgaggtgccagatgtgacacccagttcgacccagtctccatcctccctgtctgcatctgtaggagacagntcacatcacttgccgacaagtcagatcgttancgccttattaaattggtatcaagaacaaaaaccagggaaacgccctaaactcctagattctttgaattcgacatcctaaagtttgcggtaggtcgggtaccctatcacgtcttcactggcagtggactgtgggatagtactttcgacttctaccaacctanacgaggtccggttacctacccgtaaaccttggaaacgttactttttcgaacctttaaacttaccttaacgtcgtaacctaaacgagttaacgtttagacgtaccgttaaccccggttagtaccggtttaccgggaccgtaacggggaccgtaagggtacgtagtacgtaaaccgaaaacgtacgtggtcggtactacggctaaacgtacttcgttcgttaccttaacttagtacccgttccgccttacg

SEQ ID NO: 19425 - DNA, 768 bp, Homo sapiens
  misc_feature: GYAE6OF01ACL22.14.64.F09.1.454.CMB.1.raw
  modified_base (133)..(133): a, c, t, g, unknown or other
  misc_feature (133)..(133): n is a, c, g, or t
  modified_base (193)..(193): a, c, t, g, unknown or other
  misc_feature (193)..(193): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtnccagatgtgacacccagttcgacccagtcctccatcctccctgtctgcatcgtgtagganacagacgtcaccatctacgttcggaccggaacaagtcagtagtcgttaactcgtacttaatttaaagttggtactacgaacgaaccgaaaaaaccgacggggtaaacctcccctaaccttctacgtacttcgtttagatcgaccactacctaagtttcgacgtaggtacgggtccgggtacccacgtccgaccgtccttacgacgtcggtacgtaggtcggtaccgttacggtacgggtaactaaggttacgtttacctaaccgttcctaaccgtaaccacgtaccgtacggttacccggtaccttaacccgtaacgttacggtaaacgttacgttttacggaacctttaaaccgttaccttaaccgttacgtaaccgtaacgtacgttaacgttacgtacggtaacccgttaacccgggttacggtacccggttaccgggtaaccgggaacggggtaaccgtaaggggacggtaacgtactaaccggaaacgtacggtggtccggtacgtacgaaccgtaccgttgttacccggttacgttaccttaccgtaccctttcccgtaaccccgtacg

SEQ ID NO: 19426 - DNA, 692 bp, Homo sapiens
  misc_feature: GYAE6OF01BNXMJ.14.64.F09.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacgttgccgganaagtcagagtcgttatcgtaccttaattttaaacgttggtatcaagtaaccaaaaaaccggagggaaaccgtacccctaaacctcctagtattctttagatgactactcctaagtttgacgaggtacggtcgggtaccctagtcacgtcttcgacgtggactaggtgctcgagggacagtacttcactctaccactactacgtacgtccggttcctacctaacgttaggtaacttactttacgaaccttaacctttactacgttacgaactaaacgagttaacgttagtaccgttacccgtacccgggtacggtacccggtacgggtacccgggtaacggggtaaccgtaaggggtacggtaacggtaaccgtaaacggaaaaccggtacgttacgggtacggtaccgtacggtaccctaaccgtacttaccgtttacgttaccgtttacctaccctttcccgtccccgtaaccg

SEQ ID NO: 19427 - DNA, 712 bp, Homo sapiens
  misc_feature: GYAE6OF01EKUVI.14.64.F09.1.454.CMB.1.raw
  modified_base (279)..(279): a, c, t, g, unknown or other
  misc_feature (279)..(279): n is a, c, g, or t
  modified_base (661)..(661): a, c, t, g, unknown or other
  misc_feature (661)..(661): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtccaccatcacttcgccggacaagtcagagtcgttatcgaccttaatttaaagttggtatcagacaaaaaccgagggaaaccnccctaactcctagtactctttagatgacctatacctaagtttgacgtaaggtacggtccggggtacccagttccgaacgtccttaccgacgtcggacgtaggtcggccgtcgtacgggtaacctaggtactttaccgaccttcgacctactactcgacggtccgttacccaccgtaactaggtaagttactttacgacttaaacctttacgtactacgtaacaaacgtagttaacgtttacacggtaacccgttaaccccgggttgggtaacccggttccgggtaaccggtaacgggggaaccctaagggggtacgtaacgtaacgttaaccgaaaacggttaccggttaggccgggttaactacggtacccgaacccgttnttaccgttaccgtttaccttaacccgttccgttcccgttcccccgtaaccg

SEQ ID NO: 19428 - DNA, 631 bp, Homo sapiens
  misc_feature: GYAE6OF01EQHIL.14.64.F09.1.454.CMB.1.raw
  modified_base (215)..(215): a, c, t, g, unknown or other
  misc_feature (215)..(215): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccttgtctgcatctgtaggagacagagtcaccatcacttgccgganaagtcagagcgttatcgaccttatttaattggtatcagacaaaaaccaggaaacaccctaacctacctgacttcttttgatcgactacttaccgtaatttcggacaggtacggtcggggtcccagtccacgtcttcgacgtggcgaggtggctcgtggactacgtatttccacttctaccactactcgacggtccggttacctaccgtaaccgtagtaaacgttacttttacgacttaaccgttactacgttacgtacaacgtacgtagttactagtaccgtacccgtgggtaccgtcgggacgtacggggtaccagggtacggaagtacgtaactaaaccggaagttacgggtcggtacgtacgaccgtaccgtacgttcgttcttacgttaccttcttcccgtacccgtacccg

SEQ ID NO: 19429 - DNA, 792 bp, Homo sapiens
  misc_feature: GYAE6OF01AO1T2.14.64.F09.1.454.CMB.1.raw
  modified_base (136)..(136): a, c, t, g, unknown or other
  misc_feature (136)..(136): n is a, c, g, or t
  modified_base (140)..(140): a, c, t, g, unknown or other
  misc_feature (140)..(140): n is a, c, g, or t
  modified_base (192)..(192): a, c, t, g, unknown or other
  misc_feature (192)..(192): n is a, c, g, or t
  modified_base (751)..(751): a, c, t, g, unknown or other
  misc_feature (751)..(751): n is a, c, g, or t
tcagcgtctagtaccacgaccggtgctcgatttagcgcgtatacaagggggagtcagtctcagtcaggacacagcatggacatgagggtccccgctcagctcctggggctcctgctactctgctcgaggtgccagntgtnacacccagttgacccagtctccatcctccctgtctgcctatcgtagtagganacagacgtcacctatcacgttcggaccggtacaacgtccgaaggtacgtcggtttaactccgtaccgttttaattttaaacgtttggttaacttacgaacgtaaaccgtaaaaaaccggaacggggtaaacccgttaaacccccttaaccttaccgtacgttacgtttaccctttaggtaacttcggacttaaccttaccttaagtttaccgacgttacgggtaacgggttcggggttacccctacttaccgtaaccgttccttacggaacgttcggcgtacgggttacggcgttacggttacgggaactagggttacctttactccgttactaccctaacgtacctccgtaacggttccggtaacccttacccgtaacgttacggttaaacgttcgttactacttaaacctacgttacttacgtactaacgaattctacgtatacccgttccggtaagttaccggtcggtaaccggtaacgggtaggtaaccggttacggattaaccggaccttaaacggtaccggttacgacgggtactacggtaccaccgtttacncgggtttaccctcggtactttacccggtccttcccgtaccg

SEQ ID NO: 19430 - DNA, 677 bp, Homo sapiens
  misc_feature: GYAE6OF01D7C9J.14.64.F09.1.454.CMB.1.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
  modified_base (526)..(526): a, c, t, g, unknown or other
  misc_feature (526)..(526): n is a, c, g, or t
  modified_base (645)..(645): a, c, t, g, unknown or other
  misc_feature (645)..(645): n is a, c, g, or t
  modified_base (661)..(661): a, c, t, g, unknown or other
  misc_feature (661)..(661): n is a, c, g, or t
  modified_base (667)..(667): a, c, t, g, unknown or other
  misc_feature (667)..(667): n is a, c, g, or t
tcagcgtctagtaccacgaccggtgctcgatttagcgcgtatacaaggggggagtcagtctcagtcaggacacagcatggacatgagggtccccgctcagctccgtggggctcctgctactctggcctccggaggtgccagatgtgacaccagttcgacccagtcctccactcctccctgtctgcatctgtagacgacaagcgtcaccatcgacgttgaccccggaanagtnagtacgtcgttacgctacctttaatttaaagttgtaactacgaacgaaaccgaaaaaaccgngggtaaaacctacccctaaaccttaccgagttacgtaccgttttaggaacttacgacctaaccttaaccgtaattttacggacgtaaacgggtacggttccgggtacccacgttacccggaacttccttaacgtacgtccggaaccgtaggtcggtacccgtaggtcgggaactagttaacgttccacgttacactaccatcggtcgacccgtacctacgaactggtaattnttacgactaacttcgtactacgtacaacttagtaacgttcgacaaccggtcggtacgtccggttaccgggaccgtaacgggacggttaacggagtaacgagtaacgaacgtacgcgtancgcgtacatcacgttntacttnccgtctacgc

SEQ ID NO: 19431 - DNA, 737 bp, Homo sapiens
  misc_feature: GYAE6OF01ES6YG.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgaccacccagttcgacccagtcctccatccctccctgtctgcatctgtaggagacagacgtccaccatcacttcgaccggacaagtcagagtacgttatccgtaccttaattttaaagttggtactacgaagaaccaaaaaaccgacggggaaaaccctaccccttaaaccctaccgtagtacttaccgttttgaattcgacctaacttacctaagtttggaccgtaagggtacgggttccgggtaccccatacccgtacgtccttaccgacgttggacgtagggtcgtccgttcggtacgggtaactagttacgtttaccaccttccaccctacctacgtacgtaccggtccgttaccctaccgtaacgttaggtaattactttacgaactttaaccttactacgtacgtacaacgtagtattacgcgtaaccgtccgtagggtacccgtacgggaccggtacggggtaacctagggtacggaacgtaacgtaccaaaaccggttacgttacgtaccgggttaccgtacggtaccacccgttaagttccttaccggtttcccttaacccgtacctttcccccgtccccgttaacg

SEQ ID NO: 19432 - DNA, 794 bp, Homo sapiens
  misc_feature: GYAE6OF01BDK4M.14.64.F09.1.454.CMB.1.raw
  modified_base (190)..(190): a, c, t, g, unknown or other
  misc_feature (190)..(190): n is a, c, g, or t
  modified_base (263)..(263): a, c, t, g, unknown or other
  misc_feature (263)..(263): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatccctcctgtctgcatctgtagganacagctcaccatcacttgccggacaagtcagagcgttatcgctaatttaatgtatcagacaaaacagggaacnccctaactctgtatcttgatcgctatccaatttgcaggtcgtcgggtaccatcacgtcttcacgtggctaggtcggctcgtacgggtactacgtactttcctacgttcctaccgaaccctacgtactacggtcccgggttaccctaccgtaaaccgtttagtaaacggtttaactttttacgaacctttaaacccttttaccgtttaaccgttaccgttaaccgtaaacccgtaagttaacgggtttacttaaccgggttaacccgtttacccccgggtacgggtttaacccgggttaacccgggtaccggggtaaaacccgggggttaacccggtaacggggggttaacgggtaaccgtaaaacggtttaaaccccgtaaaaaccgggttaaccggtttacgggttaaccggggtaccttaacccggtaacccgttaaacccccggtttgtttaaccccggtttaaccgtttttaccccgtttaacccgtttacccggttaacccccggttttcccccccggtaaccccg

SEQ ID NO: 19433 - DNA, 750 bp, Homo sapiens
  misc_feature: GYAE6OF01A9LTG.14.64.F09.1.454.CMB.1.raw
  modified_base (137)..(137): a, c, t, g, unknown or other
  misc_feature (137)..(137): n is a, c, g, or t
tcagcgtctagtaccacgaccggtgctcgatttagcgcgtatacaaggggggagtcagtctcagtcaggacacagcatggacatgagggtccccgctcagcctccgtggggctcctgctactcgtggctcggaggtnccagatgcgacacctagttcgacctagtcctccactccctcctgtctgctatcgtagtaggagacgagctaccgactatcgacgtcggaccgactaagcgtagacgtacgttactacgtacttaatttaagtcgtatacgaacgaaacaaaaccggacggtaacctacccttacgtctacgtattcgtagtactacgtactacttacgttacgttcggacgtacggtacggtccggtactaccgtacgtacctctaccgacggtcggactcggtacgtcgtacggtaggtacttacgtcttaccacttccgtactaccgtacgtacccgtacggttacctaaccccgttaacgtaaacgtttacggttaaacttaccgtttaacgtaacctttaaccgttacttacgtaccgtaactaacggtagttaccttaacggtacccgtacgtaccggggttacgtacccggggtacgtacgggtaacgggtaacgggttcgaacgggaacttaaccggtaacgtaaacgtcggttacgggtcggtacctaaggcccgttaacttccggttaccgttacgttcccttaaccgttaccgtttccccgacccgtttaacg

SEQ ID NO: 19434 - DNA, 796 bp, Homo sapiens
  misc_feature: GYAE6OF01BTJOJ.14.64.F09.1.454.CMB.1.raw
  modified_base (149)..(149): a, c, t, g, unknown or other
  misc_feature (149)..(149): n is a, c, g, or t
  modified_base (238)..(238): a, c, t, g, unknown or other
  misc_feature (238)..(238): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccngttgacccagtcctcatcctccctgtctgcatctgtaggagacagacgtccacctatcacgttcgaccggaacaagtcagagtcgttancgtaccttaagtttaagttggtacttacgaagaaccaaaaaccgagggaaaccgacccctaaccttaccgtagtaactttcgtttaggactcggtacctactaccctaaagtttcgaccgtaaggtacgggttccgggtaccctacgttaccgaccgttaccgtttaccgaccggttcggtacccggttaaggttccgggtaccgttacggttaacgggggaacccttaaggttaaccgttttacccacccggttaccttacccgtaaacccgttacgttaccggtaaccggttcccgggttaaccctacccgtaaaccgttaggtaaaccgtttacgttttaccgaacctttaaacccgtttaacgttacgttacgtaaccgtaaacgtaacggtttacgtttaacgtaccgttaacccggttacccggttagggtacccgggtaccgtaccgggaacgggtaccgtagggtacgaagtacgtaaccgaacgtacggtggtcgtactacgacctctacgttccttaccgttaccttaccgccttcccgtcccgtacg

SEQ ID NO: 19435 - DNA, 701 bp, Homo sapiens
  misc_feature: GYAE6OF01CDT9R.14.64.F09.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (245)..(246): a, c, t, g, unknown or other
  misc_feature (245)..(246): n is a, c, g, or t
  modified_base (263)..(263): a, c, t, g, unknown or other
  misc_feature (263)..(263): n is a, c, g, or t
  modified_base (499)..(499): a, c, t, g, unknown or other
  misc_feature (499)..(499): n is a, c, g, or t
tcagcgtctagtaccacgaccggtgctcgatttagcgcgtatacaagggggagtcagtctcagtcaggacacagcatggacatgagggtccccgactcaggctcctggggctcctgcctactctggctccggagtgccagatggtgacacccgagttcgacccagttctccatcctccctgtctgcatctgtggacacagagtcaccatcacttcgcgacagtcagncgtancgctattaatgannagacaaaacgaggaacnccctaactcgtagactcgtttagatcgactactcctaatttgacgtagtacggtcgggtacccagtacacggtacttcgacgtggctaaggtcggacttccggaagggactgttacttaccgacttccgtacacgtactcgacgtccgtaccttccaaaccggttgaaacgtttagtttcgaaccctttaagtttacccgtaacgtttgtaaacctaacgtaaggtaacggtttanaaccggtacgtttaccccggttaggggtacccggtttccggggtacccggtaaggggttaaccctaaggggtacgggtaagtaacccgttaacggaaaaccgtacgttacgggttacggtcccgtaagggtacccctaaaccctacgttacgtttaccgtttacccgtttcaaccgtttccccgtttccccggttaaacccg

SEQ ID NO: 19436 - DNA, 668 bp, Homo sapiens
  misc_feature: GYAE6OF01BEUJN.14.64.F09.1.454.CMB.1.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagcgtctagtaccacgaccggtgctcgatttagcgcgtatacaaggggggagtcagtctcagtcaggacacagcatggacatgagggtccccgctcagctccgtggggctcctgctactctggctccggaggtgccagatgtgaccacccagttcgacccagtctccatccctccctgtctgctatctggtagganacagagtccaccagtctacttcgaccggaacaagtcaaggtagtcttancggtactttaaatttaagttgtactacgaacgtaacaaaacgacggaaacctcccctaactcctgtacttcttagactcgactactacctagttcgagtaggtcggtcgggtacctatcgtaccgtctcgacgtgactaggcgcgtcgtaggactagttcttcaccgttnaccgtaacnctacgcgtaccgtccaaccgtacgtactaagttatttacgacttacttactacgttagaacctaagtacgttaacgtactacgtacggtacccgttcggtaacggttcccggaacgggtaccgggtaacggtaccgggtaggaacgttacgtaaaccggtaaacgttacggtacggtcgtaacgaccgaccgtaccttaacgttcgttacgttacgtcccgttacctttcccgtccgtaccg

SEQ ID NO: 19437 - DNA, 698 bp, Homo sapiens
  misc_feature: GYAE6OF01EGT55.14.64.F09.1.454.CMB.1.raw
  modified_base (192)..(192): a, c, t, g, unknown or other
  misc_feature (192)..(192): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagacganagagtcacatcacttcgccggacaagtcagagtcgttatcgtacttaatttaattggtatcagacaaaacaggaacgccctaactctgatctttgatgctactcctaatttcgacgaggtaggtcgggtaccctacgtcgtaccgtccttaccgacgtcggacctaggtcggtacgtcggtgggaactacgtacttttccacttccgtacctactagtaccgacggtaccggtaccctaccgtaaccgttacgtaaagttacttttacgacttaaaccgtttacctacgttacggtaataaacgttagtacgttaacgtaccgtaaccgtttacccgggacgggttaccggttacccggtaaccgggaaccggggtacgtaacgggttaggaaacgtacgtaaccgtaaaccgtacggttacggtacggtaccgtacgtaccggaacctttacgttaccgttcggtttacccttaccgtaccgttccccttaccccgggtaacccg

SEQ ID NO: 19438 - DNA, 618 bp, Homo sapiens
  misc_feature: GYAE6OF01AREYA.14.64.F09.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (403)..(403): a, c, t, g, unknown or other
  misc_feature (403)..(403): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
tcagcgtctagtaccacgaccggtgctcgatttagcgcgtatacaagggggagtcagtctcagtcaggacacagcatggacatgagggtccccgctcagctccgtggggctccctgctactctggctcgaggtgccagatgtgacacccagttgacccagtctccattccctccctgtcttagctattccgtgtaggagacagacgtcacatcacttggccggactaagtccaagngtcgttancgtacttaatttaaagttgaatcgaacgaacctaaaaaccgagggtaaaacctccctaaacccgttcctaggtacttcgtttacggactgtacctacgtacctaagtttcgactacggtaggttccgggtaccacgttccacgtccttacgacgcggtnaggttcgcttaggacggtactagtactttccacttcgactaccgactcgagtcccgttctaccagtctaaagttcttagaccttaacgtcttagtctacaactgttatagtactacgtcccgtagggtaccgngtacccggaggtaacnggtacggtaaaccgtgaaaccgtagtcggntcancacgtacttgtcctataccncttccgtccncg

SEQ ID NO: 19439 - DNA, 493 bp, Homo sapiens
  misc_feature: GYAE6OF02FIJ05.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctattaaattggtatcagcaaaaaccagggaaagcccctaactcctgatcttgatgcatccaatttgcagagtgggtcccatcacgcttcactggcagtggctctgggacagatttcactctcaccatcagcggtctccaacctgaagattttgcaacttactactgtcaacagagttatgataccccgtggacgttcggccaggggaccaaggtggagatcaacgactgtggctgcaccatctgtcttcatcttcccgc

SEQ ID NO: 19440 - DNA, 517 bp, Homo sapiens
  misc_feature: GYAE6OF02ICOLJ.14.64.F09.1.454.CMB.1.raw
  modified_base (466)..(466): a, c, t, g, unknown or other
  misc_feature (466)..(466): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacgcccctaactcctgatctttgatgcatccaatttgcagagtgggtcccatcacgcttcactggcagtgctctgggacagtattcactctcacatcagcgtctccaactgaagtatttgactaacttactacttgtacaacagtagttatgacttaccccggtgaccgttcgggccgaaggggtaccaagggtggaanatacaacgactggtgactggactaccgatctgttccttacacttcctccgc

SEQ ID NO: 19441 - DNA, 973 bp, Homo sapiens
  misc_feature: GYAE6OF02HJ2GZ.14.64.F09.1.454.CMB.1.raw
tcagcgtctagtaccacgaccggtgctcgatttagcgcgtatacaaggggtaggttcaggtctcagtcaggacacctagccagtggaccaagtcgtacgggtccccgtcgtcagcctccgtggggctccgtgcctactcgtgggcttccgacggtgccgaagtaggtgtgacaccctaggttttcgaccctaggtccttaccttaagtaccgttcccgtcgtacttggtcaagttcgtcgtaacggtaggtacgaggtacgttcggaaccgacttccgtaccttagggccccggggggtacctaaggtacacggtacgtcccggtttagtccggaccttacttttaaactttggggtaatttccaacgtcgaaaaaccgagggaaaacgtcccccttaacgtccctggtaacttcggtttcgactggcctacgtaccggaaaggttttcgacggtaaggtacggggtttcggggggtaccccctaacgttaccgtaaaccggtaaaaccgttcgtaacggttaagggtccgaacggttacggtaacccttacggtttaggggtaaccgtaacggttacttttaccgtaaccgttaccttaccgggaacccctaagtttcccgaaccgggttcccggttaccccttaacccggtaaaaccccggttacgggaaaaccgttaccgttttttaaacggaaccccttaaaccttttaaccgttaaccgtttacggtttacctaaaccgtaacggttaaacgttttaccgtaaacggttaacccgttaacccccgggttaggggtaacccggttttacccgggggacccgtaaaccggggggaacccgtaacggggttacggaacggttaacgttaaccgaacggttaacggttcgggtaacgggaccgttaggtaccgtaccgtaggttccgttcgggtaccttaccggtaaccttcccgtttaccccggtaacccg

SEQ ID NO: 19442 - DNA, 545 bp, Homo sapiens
  misc_feature: GYAE6OF02ICEVP.14.64.F09.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (383)..(383): a, c, t, g, unknown or other
  misc_feature (383)..(383): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccngggaaancccctaactcctgatctttgatgcatccaatttgcagagtgggtcccatcacgcttcactggcagtggctctgggacagtatttcactctcaccatcagcgtctccaactgaatntttgactaactttactactgtacaacagtagttatgaacttaccccggtgggaccgtttcgggaccgtaagggggacccaaagggtggaagtagtaccaaacggacgttggtcggcttggaccaacctagttcctcgttccttacactttcccttcccgacc

SEQ ID NO: 19443 - DNA, 518 bp, Homo sapiens
  misc_feature: GYAE6OF02IOMM9.14.64.F09.1.454.CMB.1.raw
  modified_base (231)..(231): a, c, t, g, unknown or other
  misc_feature (231)..(231): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgcctatttaaattggtatcagcaaaaaccagggaaagccccctaacctcctgattctttgatgcatccaatttgcagagtggggtcccatcacgcttcactggcagtggctcgtgggacagtatttcactctcaccatcagccggtctccaactgaagtattttgactaacttactactgtacaacagtagttatcgactaccccggtggaccgttcgccggagggaccaaggtggagagtacaacgactggtggctcgcacagtctgtcttcacttccttcccgc

SEQ ID NO: 19444 - DNA, 517 bp, Homo sapiens
  misc_feature: GYAE6OF02GGW7S.14.64.F09.1.454.CMB.1.raw
  modified_base (515)..(515): a, c, t, g, unknown or other
  misc_feature (515)..(515): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaaacctcctgatctttgatgcatccaatttgcagagtggggtcccatcacgcttcactggcagtggctctgggacagatttcactctcaccatcagcggtctccaacctgaagtattttgctaacttactactgtcaaacagtaagttatgacttaccccggtggaccgttcggccgaaggggaccaagggtggagatacaacgaactgtcggctgccaccatctgtcttcacttcctcccncc

SEQ ID NO: 19445 - DNA, 553 bp, Homo sapiens
  misc_feature: GYAE6OF02H1KY8.14.64.F09.1.454.CMB.1.raw
  modified_base (215)..(215): a, c, t, g, unknown or other
  misc_feature (215)..(215): n is a, c, g, or t
  modified_base (434)..(434): a, c, t, g, unknown or other
  misc_feature (434)..(434): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttatcgcctatttaaattggtatcagacaaaaaccagggaaacgcccctaacctcctgatcttgatgcatccaattgcagagtcgggtcccatcacgcttcactggcagtggctcgtgggacagtatttcacttctcacctatcagccggtctaccaacctgaattattttcgactaactttactacttagtacaacgtagtagttancgtactaccccggtaggtaccgttcgggaccgaggggaccaagggtcggaagacgtacgaaacgtacgtggtcggacttgaccaccagttcgtcgtccttacacttcccttcccgtacc

SEQ ID NO: 19446 - DNA, 637 bp, Homo sapiens
  misc_feature: GYAE6OF02H52UK.14.64.F09.1.454.CMB.1.raw
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacncccctaaactcctgattctttgatgcatccaatttgcagagtgggtcccatcacgcttcactggcagtggctcgtgggacagtactttcacttctacaccatcagcggtctaccaactgaattntttacgactaactttactacttgtacaaacgtagtagtttanaggtaacgttacccccggttagggtaacccggtttccgggacccggtaacgggggtaaccctaaagggggtcggtaaaggtacttaaccgaaaaccgggtaacgttgggtaacgggtcccttagggaaccctaacccgtaacgtttccgtttaccggtttacctttacccgtaacgttttcccccgttaccccgtaccccg

SEQ ID NO: 19447 - DNA, 540 bp, Homo sapiens
  misc_feature: GYAE6OF02IJZQK.14.64.F09.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagcgtctagtaccacgaccggtgctcgatttagcgcgtatacaagggggagtcgagtctcagtcaggacacagcatggacatgaggtccccgctcagctcctggggctcctgctactctggctcgaggtgccagatgtgacaccctagttgacccagtctccatcctcctgtctgcatcgtgtagagacagngtccacatcacttgccgganaagtcagtagctttacgcttaatttaattggtatcagacaaaaaccaggaaacgcccctaactcctgatcttagatgcatccaattggacagagtcgggccatcacgnttccatgcgatggctacgtgggacagtntttcactctcaccatcagcgtctaccgacngtaaatgtttnacaacttactntagtcaacatagttnagtacttacccgngtaccgtcgcgtaacggacgtacgggtagcggtaatccaaacggtatggtacgggactcggaaccttaccgaattccgacgttcgtttaccattcccgggtttaccaccc

SEQ ID NO: 19448 - DNA, 514 bp, Homo sapiens
  misc_feature: GYAE6OF02IL1E5.14.64.F09.1.454.CMB.1.raw
  modified_base (420)..(420): a, c, t, g, unknown or other
  misc_feature (420)..(420): n is a, c, g, or t
  modified_base (481)..(481): a, c, t, g, unknown or other
  misc_feature (481)..(481): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacgcccctaacctcctgatctttgatgcatccaatttgcagagtgggtcccatcacgcttcactggcagtggctcgtggacagatttcactctcacatcagcgtctccaactgaatatttgactaacttactacttgtacaactagtagttancgtactacccggtggaccgttcggccgaaggggaccaagggtgaagactacaacgtatggngctgccaccatctgttcctcacttcctccgacc

SEQ ID NO: 19449 - DNA, 522 bp, Homo sapiens
  misc_feature: GYAE6OF02JCMXF.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaactcctgatctttgatgcatccaatttgcagagtgggtcccatcacgcttcactggcagtggctcgtggacagatttcactctcacatcagcggtctccaactgaagtattttcgctaacttactactgtacaacagtagttatagtactacccgtggacgttcggaccgaggggaccaagggtcggaagatacgaacgtaactggtggacgtgaccacatactcgtcttacacttccttcccgtacc

SEQ ID NO: 19450 - DNA, 522 bp, Homo sapiens
  misc_feature: GYAE6OF02G971A.14.64.F09.1.454.CMB.1.raw
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (486)..(486): a, c, t, g, unknown or other
  misc_feature (486)..(486): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaaccagggaaacgcccctaacctcctgatctttgatgcatccaatttgcagagtggggtcccatcacgtcttcactggcagtggctcgtgggacagtatttcactctcaccatcagcgtctccaactgaatntttgactaacttactactgtacaacagtattangtactaccccggtggtaccgttcggaccgaggggaaccaagggtggagactacaacgactggnggctggaccacctatctgtcttcacttcctcccgcc

SEQ ID NO: 19451 - DNA, 502 bp, Homo sapiens
  misc_feature: GYAE6OF02FHJUP.14.64.F09.1.454.CMB.1.raw
  modified_base (477)..(477): a, c, t, g, unknown or other
  misc_feature (477)..(477): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctcactgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctcgtgggacagatttcactctcaccatcagcggtctccaacctgaagatttgctaactttactactgttacaaacagtagttatgaactacccgtggaccgttcggccaggggaccaaggtggagatcaaacgactgnggctgcacatctgtctcatctcccg

SEQ ID NO: 19452 - DNA, 635 bp, Homo sapiens
  misc_feature: GYAE6OF02J1EWQ.14.64.F09.1.454.CMB.1.raw
  modified_base (188)..(188): a, c, t, g, unknown or other
  misc_feature (188)..(188): n is a, c, g, or t
  modified_base (228)..(228): a, c, t, g, unknown or other
  misc_feature (228)..(228): n is a, c, g, or t
  modified_base (284)..(284): a, c, t, g, unknown or other
  misc_feature (284)..(284): n is a, c, g, or t
  modified_base (487)..(487): a, c, t, g, unknown or other
  misc_feature (487)..(487): n is a, c, g, or t
tcagcgtctagtaccacgaccggtgctcgatttagcgcgtatacaaggggagtcgagtctcagtcaggacacagcatggacatgagggtcccgctcagctcctggggctcctgctactctggctcgaggtgccagatgtgacacccagttgacccagtctccatcctccctgtctgcatctgtagganacagagtcaccatcacttgccggacaagtcagagcgttancgctatttaaatgtatcagcaaaacaggaagacccctaacgtcctagactactttnatgcactacaatttgacaggtacgtggggtacccagttcaccgtcttccgacgtggacctaggtcggtcttacgtacggggtaccaaggttactttaccgtacttaccttccgaacctactacgtagtccgggttaccttcccgaaaacccgtgaaacgttacttttacgacctaacgtttaaccacgtttacgtactaaacncgttaagttaactcgtaaacgttcccccggttgtaaccgggtttccgaccgtagggttaacccgaagggttcggaagttaccgactaaccggtaattcgggacgtccgtagaccgccaattcgtcgtattccgagttccctcccgtac

SEQ ID NO: 19453 - DNA, 496 bp, Homo sapiens
  misc_feature: GYAE6OF02IBFQA.14.64.F09.1.454.CMB.1.raw
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaaagtcagagcgttatcgcctatttaaattggtatcagcaaaagccaggaaagcccctaacctcctgatcttgatgcatccaatttgcagagtggggtcccatcacgcttcactgcagtggctctggacngatttcactctcaccatcagcggtctcaacctgaanatttgctaattactactgtacaacagagttatgactacccgtgacgttcggccaggggaccaaggtgagatacaaacgactgtggctgcacctatctgttctctatccttccccg

SEQ ID NO: 19454 - DNA, 586 bp, Homo sapiens
  misc_feature: GYAE6OF02H71DH.14.64.F09.1.454.CMB.1.raw
  modified_base (270)..(270): a, c, t, g, unknown or other
  misc_feature (270)..(270): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgctatttaaattggtatcagacaaaaaccagggaaacncccctaactcctgatctttgatgcatccaatttgcagtagtgggtcccatcacgcttcactggcagtggctgtgggacagtatttcactctcacctatcagcgtctaccaactgaagttatttgactaacttactacttgtacaactagtagtttatacgtaactaccccggttggtaccgtttccgggaccgaagggggaaccctaaagggtcggtaaagaactaccgaaaacgtaaccgttgggtacggaccttaggaacctaccgtaagttccgttacggttaccctttacaactttcccgttaccccgtacc

SEQ ID NO: 19455 - DNA, 527 bp, Homo sapiens
  misc_feature: GYAE6OF02F3B2A.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacgcccctaactcctgatcttgatgcatccaatttgcagagtgggtcccatcacgcttcactggcaggtgctcgtgggacagtatttcactctacaccatcagtccgtcctccaacctgaagtatttcgactaacttactactgtacaacagtattatacgtactacccggtaggtaccgttccggacgacggggacaagggtggaacgtacacgaacgacgtggtcggctgacacatcgtctctcacttcctcccgtac

SEQ ID NO: 19456 - DNA, 505 bp, Homo sapiens
  misc_feature: GYAE6OF02FHEX5.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaactcctgatctttgatgcatccaatttgcagagtggggtcccatcacgcttcactggcagtggctctgggacagatttcactctcaccatcagcggtctccaacctgaagtattttgctaacttactactgtcaacagagttatgactaccccgtggaccgttcggccaggggaccaaggtggagatcaacgactggtggctgcaccatctgtccttcattccttcccgcc

SEQ ID NO: 19457 - DNA, 520 bp, Homo sapiens
  misc_feature: GYAE6OF02IFMVB.14.64.F09.1.454.CMB.1.raw
  modified_base (272)..(272): a, c, t, g, unknown or other
  misc_feature (272)..(272): n is a, c, g, or t
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccggaggtgccagatgtgacacccagttgacccagtctccatcctccctgtctgcatctgtaggagacagagtcaccatcacttgccggacaagtcagagcgttatcgccttatttaaattggtatcagacaaaaaccagggaacncccctaactcctgatctttgatgcatccaatttgcagagtgggtccatcacgcttcactggcagtggctctgggacagtatttcacttctcactatcagcgtctccaactgatatttgctaacttactactgtacaanagtagttatgtactaccccggttaggaccgttcggccgtagggaccaaggtggaganacaacgactgacggctagccacctagtctacgtccttcgacttccttcccgac

SEQ ID NO: 19458 - DNA, 550 bp, Homo sapiens
  misc_feature: GYAE6OF02HQV85.14.64.F09.1.454.CMB.1.raw
  modified_base (431)..(431): a, c, t, g, unknown or other
  misc_feature (431)..(431): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacgcccctaactcctgatctttgatgcatccaatttgcagagtgggtcccatcacgcttcactggcagtggctctgggacagtatttcactctcaccatcagccggtctaccaactgaagtattttgactaaactttactacttcgtacaaactagaagtttancgtaactacccccggttggaccggttccgggaccgaggggaaccgaagggtgaagacgtacgaaacgtaacgtaggtggactgaccacctagtcttcgtcttacacttccttcccgtac

SEQ ID NO: 19459 - DNA, 549 bp, Homo sapiens
  misc_feature: GYAE6OF02HCM1N.14.64.F09.1.454.CMB.1.raw
  modified_base (272)..(272): a, c, t, g, unknown or other
  misc_feature (272)..(272): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgaccttaatttaaattggtatcagacaaaaacagggaaacnccccctaactcctgactctttgatgcatcctaatttgcagaggtgggtcccatcacgtctcagtggcagtggctgtggacagtatttcactcncacatcagcgtcaccaactgtaatatttgactaacttactactgtacaacgtagtagttanagtactacccgggtaggtaccgttcggaccgaacggggaccgaagggtggaagtataccgaacgtacgtggtcggctaggacctaccgtagttctcggttccttacgtacttcccgtcccacg

SEQ ID NO: 19460 - DNA, 656 bp, Homo sapiens
  misc_feature: GYAE6OF02GKVZB.14.64.F09.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
tcagcgtctagtaccacgaccggtgctcgatttagcgcgtatacaagggggagtcagtctcagtcaggacacagcatggacatgagggtcccgctcagctcctggggctcctgctactctggctccgaggtgccagatgtgacacccagttgacccagtctccatcctccctgtctgcatctgtagganacagagtcacatcacttgccgganaagtcagagcgttancgctattaatgtatcancaaaacaggaacnccctaactctgatcttnatgcatcctaattgactagtacggttgggtcccagtccacgtccttacacgtggacaggtgctcgtgggactagtctttacacttctacacctattcgacgtccggtcctaccgaaccgtaggtaacgtacttttacgaccttaaccgtttaacttaccgttacgtaaccgtaaactaacggttaagtttacgtacgtaacgttaccccggtagggtaacccggtttaccggacccggtaacggggtaaccgtaaggggtacggtaacgtaacgtaaccgaaaccggtaacgttacgggtacggtaccgttaccgacccgtaaccgttattaccggttacgttacccttacgttaccgtttacccgttaccccgttaaccg

SEQ ID NO: 19461 - DNA, 514 bp, Homo sapiens
  misc_feature: GYAE6OF02F3VO1.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaacgcccctaactcctgatctttgatgcatccaatttgcagagtgggtcccatcacgtcttcactggcagtggctcgtgggacagtatttcactctacaccatcagcgtctaccaactgaatatttcgactaacttactacttgtacaacgagtattatgactacccgtggtaccgttcggaccgagggaccaaggtggagactacgaacgactggtcgctgcacatctgtctcacttcctcccgtac

SEQ ID NO: 19462 - DNA, 594 bp, Homo sapiens
  misc_feature: GYAE6OF02GJSZB.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttatttaaattggtatcagacaaaaacagggaaacgcccctaacctctgatctttgatgctatcctaatttgcagaggtcgggtcccatcacgtcttcactggctagtggctcgtgggacagtatttcactctcacctatcgagcgtctaccaactgtaatatttacgactaacttactacttagtacaatagtagttatacgtaacgttaccccggtaggtaccggttcggaccggaacggggaacctaagggtcggaacgtaactaccgaaacgtacgtggtacggtaccttacggaaccgtaaccgtagttaccgttcgtttacctttaccgttaccgttttcccccgacttaaccg

SEQ ID NO: 19463 - DNA, 557 bp, Homo sapiens
  misc_feature: GYAE6OF02IAIC8.14.64.F09.1.454.CMB.1.raw
  modified_base (274)..(274): a, c, t, g, unknown or other
  misc_feature (274)..(274): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (555)..(555): a, c, t, g, unknown or other
  misc_feature (555)..(555): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacgttgccggacaagtcagacgcgttatcgccttaatttaaattggtatcagacaaaaaccagggaaacncccctaactcctgactctttgatgcatcctaatttgacagagtcgggtacccatccacgtctcacgtggctaggtcggctcgtagggactaaggtctttcactctcacctntcagccggtctccgaaactgaaagtnttttcgactaacttactactgtaccaaanacgtatttacgagtactaccccggtgtaccgtcggaccgtacgggacaagggtgaacgatacgaacgactggacggctcgacaccgtatcgtacgtcgttacactccgttacccncg

SEQ ID NO: 19464 - DNA, 565 bp, Homo sapiens
  misc_feature: GYAE6OF02FWP0U.14.64.F09.1.454.CMB.1.raw
  modified_base (533)..(533): a, c, t, g, unknown or other
  misc_feature (533)..(533): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctaatttaaattggtatcagacaaaaaccagggaaacgccccctaacctcctgattctttgatgctatccaatttgcagaggtcgggtcccatcacgcttcactggcagtggctcgtgggacagtactttcactctaccaccatcagtcggtcctacccaacctgaagtattttacgacctaacttacctacttcgtacaacgtagtagttactgacttaccccggtggtaccggttcggccgaacggggaccaaagggtcggaagactacgaaacgacgtggtcggactcgaccactnttcgtcgttaccttctacttccgttcccgacc

SEQ ID NO: 19465 - DNA, 607 bp, Homo sapiens
  misc_feature: GYAE6OF02H6U2W.14.64.F09.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctggtaggagacagagtcaccatcacttgccgganaagtcagagtcgttatcgccttatttaaattggtatcagacaaaaaccgaggaacncccctaactctgattcttgatgctatacctaatttgacaggtaggtcggggtacccatccgacgtcttcacgtggactagtggctcgtggacagtatttcactctcacatcagcgtctaccaactgaagtntttagactaacttactactgtacaactagtattanacgtacgttacccggtagggtaccggttaccgggaccgtaacgggggtaaccgtaaggggtcggaaacgtacgtaacgtaaacgggtacgttcgggtacggtcctacggtaccctaaccgtagttccgttacggttcctttaccgtaccgttccccgttacccgtacc

SEQ ID NO: 19466 - DNA, 630 bp, Homo sapiens
  misc_feature: GYAE6OF02HJY53.14.64.F09.1.454.CMB.1.raw
  modified_base (273)..(273): a, c, t, g, unknown or other
  misc_feature (273)..(273): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaaccgagggaaacncccctaactcctgatctttgatgcatccaattgacagagtcgggtcccatcacgtcttcacgtcggcaggtggctcgtgggactagtactttcactctaccacctatcgagtcggttcctaccgtaacctgtaaagtattttacgacttaaacttctaacttgtaccaaactagtactttatacgtaactaccccgggttaggtacccggttcgggacccggaacgggggtaacccgtaaagggtaggaacgtaacgtaaccgaaacgtaaccgttcggtacgggtaccttacggacccaaccgtacgttacgttccggttacctttaccgtacccgtttcccttaccccgtacccg

SEQ ID NO: 19467 - DNA, 623 bp, Homo sapiens
  misc_feature: GYAE6OF02GAUNI.14.64.F09.1.454.CMB.1.raw
  modified_base (389)..(389): a, c, t, g, unknown or other
  misc_feature (389)..(389): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaaacctcctagatctttgatgcatccaatttgcagagtgggtcccatcacgcttcactggcagtggtctcgtgggacagatttcactctcaccatcagcgtctcaacctgaagtnttttcgactaactttacctacttacggtacctaaacgagtaagtttactagtaaccgttacccccggtagggtacccgtttccgggacccgtaagggggtaaaccccgtaaaggggttcggaacggtaacgttaacccgaaaacgaccgttagggtacgggaccttacgggaaccaccccgtaagttcccgtttcgttaccgtttacctacgtttcccttcccccgggtaaccc

SEQ ID NO: 19468 - DNA, 604 bp, Homo sapiens
  misc_feature: GYAE6OF02JX3IN.14.64.F09.1.454.CMB.1.raw
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
tcagcgtctagtaccacgaccggtgctcgatttagcgcgtatacaaggggagtcgagtctcagtcaggacacagcatggacatgaggtcccgctcagctcctgggctcctgctactctggctccgaggtgccagatgtgacacccagttcgacccagtctccatccttccctgtcctgcatctgtaggagacagagtcaccatcacttgccggacaagtcagagtccgttatacgccttaattttaaattggtattcgagtacaaaaaccagggaaacacccccgtaaactcctacgtacttctttgaactgactataccaattttgacagtacggtgggtcccaatcacgcttcactgctagngctcnggacaggtatttcactctcacgatcagtcgcctcactnatagttttcgaaactttatacgtcgtataaaccgngttacttatcgaaccgttacccgtggtaccgtcggtaaccggacggtaaccgtagggtacggtaacggataaccggaaacgttaccgtaagttcggtccggttaacacccgacgtaccgttagttccgtttactaccttaccgtaccgttacccccgattcg

SEQ ID NO: 19469 - DNA, 552 bp, Homo sapiens
  misc_feature: GYAE6OF02GSRG9.14.64.F09.1.454.CMB.1.raw
  modified_base (272)..(272): a, c, t, g, unknown or other
  misc_feature (272)..(272): n is a, c, g, or t
  modified_base (397)..(397): a, c, t, g, unknown or other
  misc_feature (397)..(397): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaacgagggaaacncccctaacctctgattctttgatgcatcctaatttgcagtaggtcgggtcccatcacgtcttcacgtggcaggtggctcgtgggacagtatttcactctcacatcagcgtctaccaactgaagtntttgactaacttactactgtacaacgtagtagttatacgtacttacccggtggtaccgttcggaccggaaggggaactaaagggtggaagtactacgaacgtacgtggtcggctacggacacctattcgtcgttccttacacttcccttcccgac

SEQ ID NO: 19470 - DNA, 621 bp, Homo sapiens
  misc_feature: GYAE6OF02JEMYK.14.64.F09.1.454.CMB.1.raw
  modified_base (230)..(230): a, c, t, g, unknown or other
  misc_feature (230)..(230): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgcctatttaattggtatcagacaaaaccaggaaacgcccctaactcctagatctttgatgcatccaatttgcagagtgggtcccatcacgctcactgcagtggctcgtggacagtatttcactctcaccatcagtcggtctaccaactgtaagtatttcgactaacgtttactacgttagtacctaaacgtagtacgtttaatacggtaaaccgttaccccggttaggtacccggtttaccgggtacccggaacgggggtaacccgtaaaggggttacgggaaacgtaacgtaccgtaaaacggtaacgtacgggttacggaccgttacgtaccgaaccgtaacgttcgttacggtttccttaccgtacgttacccgttaccccgtaccg

SEQ ID NO: 19471 - DNA, 577 bp, Homo sapiens
  misc_feature: GYAE6OF02IS4LO.14.64.F09.1.454.CMB.1.raw
  modified_base (230)..(230): a, c, t, g, unknown or other
  misc_feature (230)..(230): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttancgccttattaaacttggtatcagacaaaaaccaggaaacgcccctaactcctgatctttgatgctatcctaattgcagtagtcgggtcccaagtcacgtcttcacgtggcagtgctcgtagggacagtatttcgactctacactatcagtacgtcaccgtaacctgaagtattttacgacctaaactttactactcgttaacaactaagtagttacacgtacgtaacccggtggtacgttacggaccgaacggggtaacctaagggtggacgtaacgtaccgaaacgacgtacggtaggtacacgtccgaacctagtctacggttcttactacttccgtccctaccg

SEQ ID NO: 19472 - DNA, 577 bp, Homo sapiens
  misc_feature: GYAE6OF02F8MRM.14.64.F09.1.454.CMB.1.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccgganaagtcagagcgttatcgcctatttaaattggtatcagacaaaaaccagggaaacncccctaactcctgatcttgatgcatccaatttgcagagtcgggtccatcacgcttcacgtggcagtggctcgnggacagtactttcactctcaccatcgagcgtctaccaactgaagtnttttacgactaacttactacttcgtacaanagtattatcgtaactacccggtaggtaccgttcggaccgtaaggggaaccgtaaggtcggaacgacgttaacgaaacgtaaccgtagggtacggactacggacccaaccgtagttaccgttacgttccgttacctacgttcccgttaccccgtacccg

SEQ ID NO: 19473 - DNA, 621 bp, Homo sapiens
  misc_feature: GYAE6OF02HVGPY.14.64.F09.1.454.CMB.1.raw
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgaccggacaagtcagagtcgttatcgtaccttaatttaaattggtatacaagaccaaaaaccgaaggaaacgacccctaacctcctagattcttgatgactatacctaatttgacagaggtcgggtacccatcacgcttacacgtggcgagtcggctcgtaggactagtatttacactctaccacatcgagcggtctaccgtaactagtaagttatttacgactaaccttatacttagtacaactagtattatacgaccgttacccggtaggtaccggtttccggaccggaacggggtaaccgtaagggtaggaacgtaagtaccgaaacgttaacgtaggtacggtaccgtggaaccctaaccgttacgtcgttacgtttaccctttactacctttacccgtcccgtaccg

SEQ ID NO: 19474 - DNA, 585 bp, Homo sapiens
  misc_feature: GYAE6OF02IANWZ.14.64.F09.1.454.CMB.1.raw
  modified_base (387)..(387): a, c, t, g, unknown or other
  misc_feature (387)..(387): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatccctccctgtctgcatctgtaggagacagagtcaccatcacttgccggacaagtcagagcgttatcgcctatttaaattggtatcagacaaaaaccgagggaaacaccccctaacctcctagtacttctttagatcgactattaccaatttgactaggaggtcgggtcccatcacgtcttacacgtggcagtcggcttcgtagggacagtactttcactcncacagtcagtccggttactcccgaactgaagttatttcgacttaacttactactgtaccaatagtagttatacgtacgttaccccggtggtaccgttcggaccgtaggggaaccgtaaggggtgaacgacgtacgaaacgtacgttaggcggtactcgaccacctagttcgtcgtccttactcttccctcccgtaccg

SEQ ID NO: 19475 - DNA, 494 bp, Homo sapiens
  misc_feature: GYAE6OF02HH3NC.14.64.F09.1.454.CMB.1.raw
  modified_base (268)..(268): a, c, t, g, unknown or other
  misc_feature (268)..(268): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (476)..(476): a, c, t, g, unknown or other
  misc_feature (476)..(476): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccaggaaancccctaactcctgatctttgatgcatccaatttgcagagtgggtcccatccacgcttcactggcagtggctcgtggacagatttcactctcaccatcagcgtcncaactgaatntttnctaacttactatgtacaacagagttatgactacccgtggacgtcgcgacgggacaaggtgagatacaagtactgtggctgccacattctntcttctattccgtccgtc

SEQ ID NO: 19476 - DNA, 621 bp, Homo sapiens
  misc_feature: GYAE6OF02JLHJH.14.64.F09.1.454.CMB.1.raw
  modified_base (235)..(235): a, c, t, g, unknown or other
  misc_feature (235)..(235): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtcctccatcctccctgtctgcatctgtaggagacagagtcaccatcacttgacccggacaagtcagagtccgttancgaccttatttaaattggtatcagacaaaaaccgaggaaacgcccctaacctcctagattctttagatgcactcctaatttcgacaggagtcggggtcccagtcacgtcttcacgtggcagtcgctcgtggacagtattcactcgtcacatcgacgccgtcctaccaacctgtaagttctttacgacctaaactttactaccttagtaccaacgtagtacgttagtacgtaccttacccgggtaggtacccgttaccgggaccggtaacggggtaacccgaagggtacggaacgtacgtaaccgaaacggtacttacgggtacggaccttcggaacctaccgtagttccgtacgttacttaccgtaccttacccgttcccgtaacg

SEQ ID NO: 19477 - DNA, 623 bp, Homo sapiens
  misc_feature: GYAE6OF02IGQX9.14.64.F09.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (546)..(546): a, c, t, g, unknown or other
  misc_feature (546)..(546): n is a, c, g, or t
  modified_base (565)..(565): a, c, t, g, unknown or other
  misc_feature (565)..(565): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctcgagtgccagatgtgacacccagttgacccagtctccatcctccctgtcctgcntctgtagganacgagacgtcaccatccagttcgaccgganaagtcagagtcgttancgccttaatttaaatcggtatcagacaaaaccgagggaacnccctaactcctacgattcttagattgactactctaatttcncagngtcggccatcacgtntaccatcgatagtcgggtctcggtaggacagttacgtttccactcccgtacaactagtacctaaggcccgttactacccgaactcggtaagttattttacggaacctactttaactacgtacgtttacaaacgtagtaagttacacgttaccgtaccccgttagtaccgtccgtaccggacggggtaaacctgggtaacgagaccgtaanaccggtaaatccgggtaanccgttaggaccctaacggaccttggtaccgttctcgttaactcccgtttacccgaccg

SEQ ID NO: 19478 - DNA, 790 bp, Homo sapiens
  misc_feature: GYAE6OF02IC1H4.14.64.F09.1.454.CMB.1.raw
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacaccagttgacccagtctccatcctccctgtctgcatctggtaggagacagagtccaccatcacttcgccggacaagtcaagagtccgttactaccgacctttaagtttaaagtttcggtaattacagaacctaaaaaaccgaagggaaaccgtaccccctaacctaccgtagattcgtttagacgtacgacctattacccaaattttggacctagggtaaggttccggggtacccattaccacgtccttactaaccgtggactgggtacggtcctggtacgggaacgtaacgttagtttaccacttaccgtaccaaacctattaccggtaacggtcccgggttaaccttacccccgaaacccgtttagggtaaacgtttaacgttttaccgtaaaccttaaacccttttaaccgtaacgttaccgtaacaaaaccgtagggtttaaacttttacggttaaccgtaaccccgtttaaaccccgggtgggggttaaccccgtttaccggggaaccgggtaacggggaacccgtaaaggggtcggtaaaacgtctaaaaccggaacgtaccggttaggtcgggtaacggttccaaccgttaaccgtagttccgttacggttacctcgtactttccccgtacccgtaac

SEQ ID NO: 19479 - DNA, 699 bp, Homo sapiens
  misc_feature: GYAE6OF02I9O0Q.14.64.F09.1.454.CMB.1.raw
  modified_base (190)..(190): a, c, t, g, unknown or other
  misc_feature (190)..(190): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcaccatcacttgccggacagtcagngcgttancgcctatttaaattggtatcagacaaaaccgagggaaacgcccctaacctcctgattcttgatgctatacctaatttcgactagnggtcgggtacccagtcacgtcttcacgtggctaggtcggtccttcgtagggactagtactttcaccttctaccacctatccacggtccggttacctacccgtaaaccgtaggtaaacgttacgttttacgaaccttaacgttacctaacgttatacctaaacgtaggttactttaagtacgtaaccgttaccccgggttagggttacccggttaccgggaacccggtaacggggggtaaccctaaaggggttaccgggaacggtaacgttaacccggaaaccggttaagttaccgggtcgggttaccgtacggtaacccgtaccttaacggttccgtttaacgttcccgtttaaccgtaacctttaccccggttcccctaacccg

SEQ ID NO: 19480 - DNA, 754 bp, Homo sapiens
  misc_feature: GYAE6OF02HGH8G.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagtcgttatccgacttaatttaaattggttatcaagacaaaaaccgaggaaacgccccctaacctcctagacttcgtttagattcgactacttacctaagttttcgactaggtacggtcggggtaccccaattccgaaccgtccttacacgtggaccgtaggtcggtcttacggtgggaactaggttactttccgacttcctacacctattaccgacggtccggttacctacccgaaaccgtagtaaacgttacttttacgaaccttaacttacccttacgttacgttaaccaaacgtagttaacgtttacgtacgtaaccgtttacccccgggttagggttacccggtttccgggaacccggttaacgggggtaaaccgtaaaggggttacgggtaaacgtacgttaaacccgaaacggttaaccggttcgggtaacggtacccgttgggtaaaccccgtaacctttaacggttccgtttacggttaccccttttaacgtacccggttttcccgttacccccgttaacccg

SEQ ID NO: 19481 - DNA, 608 bp, Homo sapiens
  misc_feature: GYAE6OF02G9NQ6.14.64.F09.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtctccatccctccctgtctgcatctgtaggagacagagtcaccatcacttgccgganaagtcagagcgttatcgccttaatttaattggtatcagacaaaaacaggaaacgcccctaacctcctgattctttgatgcatccaatttgngagaggtcggggtcccatcacgcttcgactgcgagtcggctcgtgggactagtatttcactctacacctatcagccggtctaccaacctgaacttatttcgactaaacgttctacttacgtacaacgtagtaattacgtacgtaccgttaccccgggtggtaccggttccggacccggtagggggaaccgtaaaggggtcggaagtagtaccgtaaacggtacgttacgggtaacggcgttacgaccgtaaccgtagttaccttcggttccttaccgtacctttccgttaccccgtaccc

SEQ ID NO: 19482 - DNA, 560 bp, Homo sapiens
  misc_feature: GYAE6OF02GWCUE.14.64.F09.1.454.CMB.1.raw
  modified_base (274)..(274): a, c, t, g, unknown or other
  misc_feature (274)..(274): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgccttaatttaaattggtatcagacaaaaaccgagggaaacncccctaactcctagattcttgatgcatcctaatttgacagaggtcgggtacccatcacgtcttcactggcagtggctcgtggacagtatttcactctcacatcagcgtcctaccaactgaagtatttgactaacttactacttgtacaactagtattatcgacttaccccggtagtaccgttcggaccgtaaggggacctaagggtgaagtatacgaacgtacgtggtacggactacggacaccgtagttaccgttcgttaccttccgtacttcccttcccgtacc

SEQ ID NO: 19483 - DNA, 666 bp, Homo sapiens
  misc_feature: GYAE6OF02JZ26D.14.64.F09.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttcgacccagtctccatccctccctgtctgcatctgtagganacagtagtccaccatcacgttgccganaagtcagagccgttancgaccttaatttaacttgtatcagacaaaaccgagggaaacacccctaacctcctgacttcttgatgctaatacctaatttcgacaggtacggtcggggtaccccaagttaccgacgtcttaccgaacgtcggctacggtcggtctttacgagggtaactaacggttactttaccaccgttcctaccgaaccttagtccgaacggtcgtaccctacccgtaaacctagaaacgttacttttacgaacttaacctttactaacgtcgtactaaacgtagtaacgttataccgtaacttcccgggtagtaaccggtttaccggcggaaccggggaccgttagggaacggtaacgacttaaccgaacgtacgtacggacggttactcgaaccacctagtcccgtttagtacccttgtactccccgttaccgacc

SEQ ID NO: 19484 - DNA, 619 bp, Homo sapiens
  misc_feature: GYAE6OF02IIMCS.14.64.F09.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctggtaggagacagagtcacatcacttgccgganaagtcagagcgttancgcctaatttaattggtatcagacaaaacaggaacncccctaactctgtatttgatncatactatntcagngtcgggtcctactctacgcgttacncgtacgngtagtggtctcgtagggacgatagttcactctacaccatacgtagtccggtacctaccaaccgttaggaaagttacttttacgacctaaaccgtttctacgttagtaccaaactacgtagttacgtacgaccgttacccggtacgggtacgtttcccggacgggtaaccggggaacgtaacggagggtaacacgtaaccgtaaacggtacgttcggtacggtacgtacgtaccgaaccttagtaccgttcgttacttcctaacgtttcccgtacccgcttaacgg

SEQ ID NO: 19485 - DNA, 740 bp, Homo sapiens
  misc_feature: GYAE6OF02FFGV0.14.64.F09.1.454.CMB.1.raw
  modified_base (685)..(685): a, c, t, g, unknown or other
  misc_feature (685)..(685): n is a, c, g, or t
  modified_base (705)..(705): a, c, t, g, unknown or other
  misc_feature (705)..(705): n is a, c, g, or t
tcagcgtctagtaccacgaccggtgctcgatttagcgcgtatacaagggggagtcgagtctcagtcaggacacagcatggacatggacgggtccccgctcagctccgtggggctcctgctactctggcctccgaggtcgccagatgtcgaccacccagttcgacccagtcctccactccctccctgtcctgctatctggtaggacgacacgacgtccaacctatccgtacgttcggacccgggtaaactaacgtaccgaggtacggtaccgtttacgtccgtaacctttaaagtttaaacggttacggtaactaccaaacggtaaaacccgtaaaaaaccggacgggtaaaaccccgtacccccttaaccttaccgtagtacttccttagtactcgtactactaccgtagttcgacggtaggcggtccggtacacgtcctacggtctaccgcgtggtactacggtcggtccgttaggacgggtaacttcgttaactttccaccgttacctaccgtaactcgtaccgtaccgttaccggaccttaacccggtacgtaaggtacttacgttaccgtaacctaacgttactacgttacaccgttaagtactagttacacggtacctaccgggtggtaccgtacgggacggtaacgggtacgaagtacggtacaacgtaacgacgacgngttccggactacaccttacncgttcctacgttaccttccaccgtccgttaccacg

SEQ ID NO: 19486 - DNA, 780 bp, Homo sapiens
  misc_feature: GYAE6OF02IRKB5.14.64.F09.1.454.CMB.1.raw
  modified_base (227)..(227): a, c, t, g, unknown or other
  misc_feature (227)..(227): n is a, c, g, or t
  modified_base (763)..(763): a, c, t, g, unknown or other
  misc_feature (763)..(763): n is a, c, g, or t
tcagcgtctagtaccacgaccggtgctcgatttagcgcgtatacaagggggagtcgagtctcagtcaggacacagcatggacatgagggtccccgctcagctcctggggctcctgctactctggcctccgaggtgccagatgtgacacccagttgacccagtctccatcctcctgtcctgctatctggtaggagacagagtccaacctatccacttggacccggaanaaaggttcaagtacggtcgttttaatccggtaccttaattttaaaacgttgggtatacgaagtaacctaaaaaaccggacgggaaaaccgacccccttaaacctcccgtagtaccttaccgttttacgacttacggtactacttacctaagtttcgactagggtacgtcggggtaccctagttccgtaacgccgtttaccgacgttcggtacgtacggtcggtcttcggtagggtaccaggttactttaccgaccttaccgtaccctaaccgtacgtttacgaacgggttcccgggttaaccctaacccgttaacccgttagggtaaacgtttaccgttttacggaaaccttaaccgttttaccgtaacgttacgttaacgtaaaccgtagttaacgtttacgtacgttaaccgttacccgggttacgtaacggtttcccgggaccgtaacggggtaccgaagggtacgtacggtaagtacgtaaccgtaggtacggtcgacgtacggaccacgttcgcgtttacgtccgttaacncgtttcccaccgttacg

SEQ ID NO: 19487 - DNA, 616 bp, Homo sapiens
  misc_feature: GYAE6OF02IH317.14.64.F09.1.454.CMB.1.raw
  modified_base (217)..(217): a, c, t, g, unknown or other
  misc_feature (217)..(217): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgaccgganaagtcagagtcgttatcgaccttaatttaaattggtatcagacaaaaaccgaggaaacgcccctaacctcctagattctttagatcgactattacctaatttcgctagacggttcgggtacccatcacgtcttacactcggcaggtcggctcgtggacagtacttcactctcacctatcacgtccgtcctaccaaccgtagtaagttatttcgactaactttactacttacgtactaagtagtaacgtttagacgtaccgttacccggtaggtaccgttaccggggaaccgtaacggggtaaccgtaagggtacggaacgtaacgtaaccgtaaacgtacgttaggcggtactacggacctacctagtccgttcgttacctctacttcccgtccctacc

SEQ ID NO: 19488 - DNA, 695 bp, Homo sapiens
  misc_feature: GYAE6OF02H4MG9.14.64.F09.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
  modified_base (532)..(532): a, c, t, g, unknown or other
  misc_feature (532)..(532): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgaccaccagttcgacccagtctccactcctccctgtctgctatctgtaggacanaggatccaaccatcctattacggcccgaanaagtacgagagtcgtttaacncggacctttaagttttaaagtttggtactacaaacgggaacctaaaaaaacggaaccggggaaacgtaccccccttaaaaccttccaggtaacctttcctttaaggatcgtactaacgttaccttaatttcgaccgaaggtacgggtcgggtacccaattccaacgtctcgtactaggcaggtcgnttcggcggaactagttcttcncgtactcactcgtagacgtcgtcctaacgactacgaagttacttacgaacttaacgtacttacgtactacgaaccgtntaaagttaagccgtaactacccggttacggtacgttccgaacgtaccgggtaacgaagggtcggtaaagcgttaaacggaacgttaaacgtcggtcggtaacttcgggtaaccctagtacttaccgggttacttcgttaccgtacgtttcctaaccccgttcg

SEQ ID NO: 19489 - DNA, 676 bp, Homo sapiens
  misc_feature: GYAE6OF02HLFDR.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtctccatcctccctgtctgcatctgtaggagacagagtcaccatcacttgaccggacaagtcagagtcgttatcgtaccttaattttaaagttggtaatcgaagtaaccaaaaaaccgaggggaaacgaccccctaaccgttccagtaacttcgtttagactcgtcaactacctaatttcgacaggtacggttcggggtacccaagttaccgaccggtcttaccaacgtcggtactacggtcggtcctacgtacgggactaagtactttacaccgtctaccaacgtactcgacggtcgtcctaacccgactagtaagttactttacgaccttaacgttactacgttacgtacaaacgtgtaacttaagtcgtaacgttaacccggtgggtaaccgttccggaccgggtacggggtaccgtaaagggtcggaacgtacgtacgaaacggtagtcggttacggctacggaccaactacgtcgttccggttactaccgtaccgtttcccgtacctaccg

SEQ ID NO: 19490 - DNA, 691 bp, Homo sapiens
  misc_feature: GYAE6OF02HCLI7.14.64.F09.1.454.CMB.1.raw
  modified_base (397)..(397): a, c, t, g, unknown or other
  misc_feature (397)..(397): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtcctccatccctccctgtctgcatctgtaggagacagacgtcaccatcacttcggaccggacaagtcagacgtacgttactcgtaccttaatttaaagttggtaatcaacgaacaaaaaaccgaggggaaaaccacccccgtaaacctcctgtacttctttgactgactaatcctaagtttcgacaggacggttcgggtcccatcgacgtcttcgactggcaggtcggccttacggngggaactaggttactttcctacgtctaccactacgtcgacgtccggttacctaccgtaaccttaggaaacgttcgtttacgaaccttaaaccgtttactaacttacgtacgaaaaccgttaggtaactttacgtacgttacccgtaacccgggttcggttaaccgtccgggaccgggtacggggaaaccgtagggtaacggagtaacgaccgaaacggtatcgggtacgaccgttacgacctaaccgttgttaccttcggttacccttacgtaccctttcccgtacccgtaccg

SEQ ID NO: 19491 - DNA, 721 bp, Homo sapiens
  misc_feature: GYAE6OF02I1IZH.14.64.F09.1.454.CMB.1.raw
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcacatcacttgccggacaagtcagagcgttatcgccttaatttaaattggtatcagaccaaaaaccgagggaaacgaccccctaacctcctagattctttagatcgactactacctaaatttcggacgtaaggtacggttaccggggtacccctagtaccgaccgtctttacgaccgttggcgtaggtcggtctcggtgggactagttactttcgaccttcgtaccacctagtccgaacggtacccggttcctaacccgtaaaccgttggtaaaacgttacgtttttacgaacccttaaaccgtttaccctaacggttactaaccgtaaacgttaggttaactttacgtaccggtaacccgttaacccgggttacgggtaaccggtttaccgggaaccgggtacggggaaacccgttaaggggtacggtaaacgtaactaaccgtaacggtacgttacggtcggtaacctcgaacctaccgtagtttacgtcgtttacctcgtaccgtttcccgtacccgtac

SEQ ID NO: 19492 - DNA, 841 bp, Homo sapiens
  misc_feature: GYAE6OF02I7KEN.14.64.F09.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (248)..(249): a, c, t, g, unknown or other
  misc_feature (248)..(249): n is a, c, g, or t
tcagcgtctagtaccacgaccggtgctcgatttagcgcgtatacaaggggggatcagtctcagtcaggacacagcatggacatgagggtccccgctcagctcctggggctcctgctactctggctccgaggtgccagatgtgacacccagttgacccagtctcatcctccctgtctgcatcgtgtagganacagagtccaccatcattcggccganaagtcagagtctatcgacttattaaatggtannagtaccaaaacgaggaacgccccctaactctgtaatctttagatcgtactacttacctaagtttcgacgtaacggacggtttccggggtcccctaatcccgtaacgtccctttacacgttcgggacacggttcggcttcgtacggggaactaacgttatttaccaccttacgttcccaaaaccgtgtcccgtacggttacccgggttacccttaaccccgtaaaccggttaaggtaaacggtttaccgtttttacgaaacccttaaaccgttttacgttaaacccgttacggtaaaccctaaaaacggttaccggtttaaacgtttttaacggaaccgggtttaaccccgttaacccccggggtttaaaggggttacccccggtttaaaccggggggtaccccgggtaaacccgggggtaaaccccggttaaaggggtaccgggtaaccgttaaaccgttaaaccggtaaaacccggttagggtttaacggtcccgttaaccggtaaacgggtcccctaaacccggttagttttaccgttaccgtttaacccgttacgtttaaacccccgtttccccgtttaccggaacccc

SEQ ID NO: 19493 - DNA, 609 bp, Homo sapiens
  misc_feature: GYAE6OF02IFTZN.14.64.F09.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (377)..(377): a, c, t, g, unknown or other
  misc_feature (377)..(377): n is a, c, g, or t
  modified_base (442)..(442): a, c, t, g, unknown or other
  misc_feature (442)..(442): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagngtcaccatcacttgccgganaagtcagagcgttancgcctatttaaattggtatcagcaaaaaccngggaaacncccctaactcctgatctttgatgcatcaatttgctagagtgggtcccagtcgacgtcttcacgtggaccaggtggactcgtagggacagtatttcactctcaacctntcacgcggtctaccaactgaagtatttcgactaacttacgacttagacaaacgagtaacgtttanacgtacgtaccccggtgggtaaccgtttccgggaccgtaaggggaccctaagggtcggtaacgtaacgttacgaaaaccggtacgtttcggtacggtaccgttacggacctaaccctaagttccgtacgtttccctttaacgaacgttccccgtttacccgaacccg

SEQ ID NO: 19494 - DNA, 744 bp, Homo sapiens
  misc_feature: GYAE6OF02HH2VA.14.64.F09.1.454.CMB.1.raw
  modified_base (225)..(225): a, c, t, g, unknown or other
  misc_feature (225)..(225): n is a, c, g, or t
tcagcgtctagtaccacgaccggtgctcgatttagcgcgtatacaaggggggagtcagtctcagtcaggacacagcatggacatgagggtccccgctcagctcctggggctcctgatactctggctccggaggtgccagatgtgaccacccagttcgacccagtctccatccctccctgtctgcatctgtaggagacagagtcaaccatcacttggacccggaanaagtcagagtcgttactcgtaccttaatttaaagttggtactacgaagaaccaaaaaccggtaagggaaacctaccccctaacttcctagtacttcgtttagaatcgactacttaccttaagtttcgacgtaggtacggttccgggtacccagtccgtaacggtccttcgacgtcggacgtaggtcggtcttacggtacgggactaaggttcttactaccgttactaccaaccttcgtacgaccggttccgttacctaacctaaaccggtagtaacgtttacttttacgaaccttaaacttttccgtaacgttcgtaaacaaacgtaggttaagtttaacgtaccgtaaccgttaacccgggttacggtaccggttaccgggaaccgggtaacgggttaaccgaacggggtagaaaccggtaacgtaaaccggtaacgtacggtcggtaacggtccgtaacgtaccgaaccgttacgttccgttacgtaccgttctacccggttaccctcccgttaacg

SEQ ID NO: 19495 - DNA, 694 bp, Homo sapiens
  misc_feature: GYAE6OF02GKTXF.14.64.F09.1.454.CMB.1.raw
  modified_base (281)..(281): a, c, t, g, unknown or other
  misc_feature (281)..(281): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttcgacccagtcctccatccctccctgtctgcatctgtaggagacagagtcacatcacgttgccggaacaagtcagagtcgttatcgacttaatttaaagttggtatcagaacaaaaaccgagggaaaccnccccctaactcctagtacttcgtttagacgtcgactactaccgtaatttcggacgtaggtacgggttcgggtacccagttccgaaccgtccttacacggtggacgtaggtcggtccgtcggtacgggaactagttactttaccacttaccaccacctagtccgacggtccgtaccctaaccgtaacgtagtaaacgtttatttacgaccttaacgttacctacgttacgtaacaacgtagttacgttacgtacgtaacccgttacccggtagggtaccgttaccgggaccggtaacgggtaaccgtaagggtcggaaacgtaacgtaacgaacggtacgttgggtacggtaccgtacgtacccgaacgttcgttacgttcgttcccttacgtaccgtttcccctacccgtacg

SEQ ID NO: 19496 - DNA, 667 bp, Homo sapiens
  misc_feature: GYAE6OF02I6QPB.14.64.F09.1.454.CMB.1.raw
  modified_base (194)..(194): a, c, t, g, unknown or other
  misc_feature (194)..(194): n is a, c, g, or t
  modified_base (407)..(407): a, c, t, g, unknown or other
  misc_feature (407)..(407): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgagtgccagatgtgacacccagttcgacccagtcctccatccctccctgtcctgcattctgtagganacagagtccacatcacgttgcccggaacaagtcagagtcgttatcgaccttaagtttaattggtatacagaccaaaacgaggaaaccaccctaacctcctagtacttctttagatacgtacactcctaattgacagtcgtacgggtccctatctacgccttacacgtacggcacggtcgctcgtaggactagtattcgaccttctaccgtacncgttcgacgtacgttcctacccgaacttacgtaacgttacttttacgaccttaacgtttacttaccgtacgttacaaacctacggttaacttagtaccgttaacgtaccccgggttagaccgttacggaaccggtacggggtaaccgtaagggtacgtagacgttaaacccgaacgtaacgtcggtaacggtaccgtaggtacccaacggttacttacggttcgttaccgttacctacgtttaccccgtcccgttaaccg

SEQ ID NO: 19497 - DNA, 680 bp, Homo sapiens
  misc_feature: GYAE6OF02IP672.14.64.F09.1.454.CMB.1.raw
  modified_base (235)..(235): a, c, t, g, unknown or other
  misc_feature (235)..(235): n is a, c, g, or t
tcagcgtctagtaccacgaccggtgctcgattttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcacatcacttcggaccggacaagtcagagtcgttancgtactaatttaaagttgtatacagacaaaaaccgagggaaacacccctaacctctagactctttagatgactatacctaatttgacagaggtcgggtacccatcacgtctcacgtgacgagtgctcgtaggactacgtactttcgacctctacaacctacgtacgtacggtccgtaccctacccgtaaaccttaggaaacgtttacgttttacgaaccttaaacttttacctaacgttacgtaacctaaacgtaacggttaattacgttaacggtaaccgttaccccgggttagggttaacccggttcccgggtaaccgggtaacgggaacccggtaagggtaaggaacgtaactaaaccggtaaacgaacgttacgggtacgtaccgtacgacctaccgtacttccgtacgtttcccttataaccgttcccttacccgtaccg

SEQ ID NO: 19498 - DNA, 626 bp, Homo sapiens
  misc_feature: GYAE6OF02F2ECA.14.64.F09.1.454.CMB.1.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcactatcacttgccgganaagtcagagtcgttatccgtccttaatttaaagttggtatcagaccaaaaaccgagggaaacncccctaacctcctagacttcttgatcgactatacctaatttacgcaggtaggtcgggtcccaagtcacgtcttcacgtggacagtcggctcggnggacagtacttcacttctccactancgtaggtccgtacccacgtaacctagaagttctttagaccttaacttacgtactcgtaacaagtacgttaattacacgttaccgttacccggtaggtaccggtttccgggaccggtaacggggaaccgtaagggtacggtaagtaaccgtaacgtaacggtaacttgggacggttcgacgacctaaccgtacgttactcgttaccgtactaccgttaccctccgtaccg

SEQ ID NO: 19499 - DNA, 757 bp, Homo sapiens
  misc_feature: GYAE6OF02JYWYU.14.64.F09.1.454.CMB.1.raw
  modified_base (191)..(191): a, c, t, g, unknown or other
  misc_feature (191)..(191): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatccctccctgtctgcatctgtagganacagagtccaccatcgacttcgccggacaagtcagagtcgttatcgacttattaaattggtatcagaacaaaaacgaacgggaacgtaccccctaacgtcctagtacttctttagatcgactactaccttaagtttgactaggtacggtccggggttacccactccgtaaccggtccttccgaacgtcggtacctagggttcggtaccttacggtagggaacctagtaacttttaccgacccttaccgtacaaccctagttaccgaccggtacccggttaccctaacccgtaaaccgttaggttaaacgttacttttaccgaaacctttaaaccgttaaccttaactagttaaacccaaacgttaacggttaactttaagtaaccgtaacccgggtttacccggtaaccgggtaacggtttacccgggaaccggggttaacgggtaaacccggttaagggtaggtaacccgtaacgaacccggtaaagtaccggtagggtccggtaccgtagtaacccaccgttagtcgttacgttccttaccgtacttccccgttaccgtaaccg

SEQ ID NO: 19500 - DNA, 651 bp, Homo sapiens
  misc_feature: GYAE6OF02IK40T.14.64.F09.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (649)..(649): a, c, t, g, unknown or other
  misc_feature (649)..(649): n is a, c, g, or t
tcagcgtctagtaccacgaccggtgctcgatttagcgcgtatacaagggggagtcgagtctcagtcaggacacagcatggacatgagggtccccgctcagctctggggctcctgctactctggctcgagtgccagatgtgacacccgagttcgacccagtctccattccctcctgtcctgcatctgtagganacagagtcaccatcacttgccganaagtcagagtcttancgacttatttaagttggtatacagtaacaaaaacgnggaaacgccccttaaacgtcctagacttctttagattcgctaatccgtaatttcgactagacggtcgggttaccacgttcacgttcttacacgtggcctaggtcggactcgtagggactaggttactttcacgttctaccgacctatacgtacgtccgtacctaccgtaaccgtagtacgttatttccgaacttaacttacgtacctggtaaccaagtacgtaagttacacggtttacgtaacccggtaggttacccgttacggaccggtaccggggaaccgtagggttacgaacggttactaacgggaaccgtaacggtggtaccggtacgtacgacccgttacgacgtattccggtacttaccggacttcccggttaccncg

SEQ ID NO: 19501 - DNA, 721 bp, Homo sapiens
  misc_feature: GYAE6OF02HL86V.14.64.F09.1.454.CMB.1.raw
  modified_base (251)..(251): a, c, t, g, unknown or other
  misc_feature (251)..(251): n is a, c, g, or t
tcagcgtctagtaccacgaccggtgctcgatttagcgcgtatacaaggggggagtcagtctcagtcaggacacagcatggacatgagggaccccgctcagctcctggggctcctgctactctggctccgaggtgccagatgtgacacccagttgacccagtcctccatcctccctgtctgcatctgtaggagacagagtcaccatcacttcgccggacaagtcagagcgttatcgacttaattaattgtancagacaaaacgaggaacgaccctaacctcctagactcttgatgctatacctaagtttgctaaggtcggttacgggtaccccagtcctacgtcttacgtacgtcggctaggtcggtcttacggtcggactagttactttcaccttcctacctaacctagttccgacggtcccggttacccttaaccccgtaaaccgttaggtaaacgtttacgttttacgaacctttaaaccgttttaccgtaacgtttacgtacctaaaacggtacgtaagtttacgtacccggttaacggttaaccccggttacgggttaccgggtacccggtaacgggtaaccgggtaaccgggtaagggttacggaacgtaaccgttaaccgaaacggttacgtcgggttacggtaccgtacgtaacccgtactacggtttaccgtcggtttacctttaccgtaccggtttccccttaccggtaccc

SEQ ID NO: 19502 - DNA, 753 bp, Homo sapiens
  misc_feature: GYAE6OF02G67A0.14.64.F09.1.454.CMB.1.raw
  modified_base (191)..(191): a, c, t, g, unknown or other
  misc_feature (191)..(191): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtctccatcctccctgtctgcatctgtagganacagagtcaccatcacgttcggccggacaagtcagacgtacgttactcgtacctttaatttaagttggtatcaagtaacaaaaaccgaagggaaaccgtacccctaacctccgtagtacttcgtttagatcgacctaactacctaagtttcgacgtaaggtacggggtccgggttaccccagttaccgtaccgtaccttaccgacggttcggacgtacgggtcggtccgttcggtacgggaactagttactttccgaaccttctaccctacctacgtaccgtacggtacccgttaccctaccgtaaccgttaggtaacgttacgttttacgaaccttaaacctttacttactacgttaccaaagttagtaacgtttacgaccggttaccttaccgggtacgggttaccggttccgggaaccggtaacggggtaccggtaagggtacggtaagtaccgtaacgggtaacgttacggttacggtacggtacctacggtaaccctacgttacgttaccgtttacgttccgttttaccgtaccccgtttaccgttacccccgtacg

SEQ ID NO: 19503 - DNA, 691 bp, Homo sapiens
  misc_feature: GYAE6OF02JDSDA.14.64.F09.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtcctccatcctccctgtctgcatctgtaggagacagagtcaccatcacttggccgganagtcagatcgttancgcttaattaattggtatcagacaaaaccgaggaacgaccccctaaccgtcctgattctttagactagctactacctaaagttttcgacgaaggtacgggttccggggtacccagttaccgacgtcctttaccgacgtggactagggtcggtcctcggttagggaaccgtagtactttccaccttccgtacctaaccgtaactacggtaccggtcccgggttactaaccccgtaaaccgtagtaaacgttagttttacgaacttaacctttaaccgtacttacggtaacctaaacgtataacgtttagtacgtaccgtacccggtacggttaccgttccggaaccggtacgggaacgtaacgggtagacgtaacgtaaccgtaacgtacgttggtacggacttaccggaacctaccgtaacgtcgttacgttccgttactaacgttccctccccgtaacg

SEQ ID NO: 19504 - DNA, 767 bp, Homo sapiens
  misc_feature: GYAE6OF02GD4NH.14.64.F09.1.454.CMB.1.raw
  modified_base (221)..(221): a, c, t, g, unknown or other
  misc_feature (221)..(221): n is a, c, g, or t
  modified_base (708)..(708): a, c, t, g, unknown or other
  misc_feature (708)..(708): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttcgacccagtcctccatccctcctgtctgcatcgtgtaggagacgagagtccacatcacttcgaccganaagtcaggtagtcgttatcgtaccttaagtttaaagttggtactacgaacgaaacctaaaaaaccggaacgggtaaacccgacccccgttaacctaccgtacgtactttcgtttacgactcgaccgtaacttacccgttaagtttcgacggtaggtacggggttaccgggtaccctacgtaccgtaccgttaccgttaccgaacggtacggtccggtaggtcggtaccgttacgggtacgggtagtacgttacgtttaccctacgttcctaaccgacctacgtaccggtaccgttcccgttacctaacccgtaacgtacggttaagtttactttaccgaaaccttaccgtttaacttccggttaacaaccgtaacgttaagtacggttaataccgggtaacccgttacccgggtagggttacccggtcgggtaaccgggacgggaaggtaccggtaagaacgttagaaaaccgtacgtaggtcgggngtccacgtccaacgttacgttccgtacgttacttacctacccgtttacccaccgttacg

SEQ ID NO: 19505 - DNA, 595 bp, Homo sapiens
  misc_feature: GYAE6OF02GBJZ7.14.64.F09.1.454.CMB.1.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtagganacagagtcacatcacttgccganagtcagancgttancgaccttatttaaattggtatcagacaaaaaccgagggaaacncccctaacctcctagattctttgatgctatccaatttgcaggaggtcgggtcccatcacgtcttcactggcaggtgctcgtgggacagtatttccactctacaccatcagtccggtcctaccgaacctggaagtattttagaccttaacttactacgttgacctaacgagtaagttactacgtaaccgttaccccgtagggtaccggttaccggaccggtacggggtacccaagggtcggagtaactaccgaacgtacgtgggtacggtccgtacgacccgtactacgttcgttcgttccttactaccgtttccttccccgtacg

SEQ ID NO: 19506 - DNA, 751 bp, Homo sapiens
  misc_feature: GYAE6OF02FMNRZ.14.64.F09.1.454.CMB.1.raw
  modified_base (236)..(236): a, c, t, g, unknown or other
  misc_feature (236)..(236): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtcctccatcctccctgtctgcatctggtagagacgagagtcaccatcacgttgccgaacaagtcagagtcgttacnccgtaccttaatttaaagttggttaatacaacgaaccaaaaaaccgaacggggaaaaccgtacccccctaaaccttccctagtacttcgttgaagtcgactaacgtaccgtaatttcgactaacggtcgggtaccgggtccctaagtccgtaaccggtccttacgaaccgtcggtactacggtcgtccgttacggtacgggaacgtaggttaactttacctaccttccgacctaaccgtatccgaacggtaccggtccctaaccgtaacccgtaggtaaagttactttaacgtacctaaacgttactaacgttcgtaactaacgaagttagttacgacggtaaccctaacccggggttaggtacccgggttaccggaacccggtaaggggtaaacccgtagggtaaccgggaaagttaacgacccgtaaaacgtacggtacgggtacggtccgttaacggtcccaaacggttacttcgtacgttccttaacgtacccttcccgtaccgtaacccg

SEQ ID NO: 19507 - DNA, 668 bp, Homo sapiens
  misc_feature: GYAE6OF02JM7WG.14.64.F09.1.454.CMB.1.raw
  modified_base (227)..(227): a, c, t, g, unknown or other
  misc_feature (227)..(227): n is a, c, g, or t
  modified_base (389)..(389): a, c, t, g, unknown or other
  misc_feature (389)..(389): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtcctccatcctccctgtctgcatctgtagagacagagtcacatcacttgccgacagtcagagcgttancgtcctatttaaatggtatcagaacaaaacgaggaaaccgcccctaacctcctagtattccttgtaactcgacctagtacctaaactttgacgtaggtacgggttagggtaccccgaattccgaacggtccttacacgtcgacgtagtcgtctacgtgggancgtattcacttcctcgactactcgaggaccgtcctacgaccgtagtaaagttcgtttgaaccttaacttaccgtagtaccgtaactaaacgtagttagttacctacggtaaccgttacccggttacgtaacggtttccgggaacccggaacggggttaacccgaaggggtacgaaacggtagtaaaccgaacgggtaaccggttgtaccgggtacttacgaaccgtaccagtttcgttacgttaccctacggtttaacctccccgggtttacaacccgg

SEQ ID NO: 19508 - DNA, 722 bp, Homo sapiens
  misc_feature: GYAE6OF02J0YBB.14.64.F09.1.454.CMB.1.raw
  modified_base (239)..(239): a, c, t, g, unknown or other
  misc_feature (239)..(239): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgaccacccagttgacccagtctccatcctccctgtctgctatctgtaggagacagagtcaccatctacgttcgaccggacaagtcagacgtcgttancgaccttaatttaagttggtatacgagaaccaaaacgacggaaaccacccctactctagtacttcttgactgaccttactacctaagtttgacctagggtacgggtccggggtaccctagtaccgtacggtaccttcgtaacggtccggtagtaaccgggttggtaccgttcggggtaacggtacgtaacgttacgtttacctaacgttacccgtacctaacgtaacgttcgaaccgggtaccgtacctacccgtaaactaggttaaacgtttacgtttaccgaaccttaaccttaccttacgttaacgtaaccgtaacgtagtaacgtactacgttacccgtaccggtacgtaccgggtccgtaaccgggaacgggttaacgtaacgggagtacggtaacgtaaccgaacgttacggtcgggtaactcgtacggaacctaccgtagttcgtacttcgttaccctcttaccccggtactaccg

SEQ ID NO: 19509 - DNA, 670 bp, Homo sapiens
  misc_feature: GYAE6OF02GYZP5.14.64.F09.1.454.CMB.1.raw
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
  modified_base (517)..(517): a, c, t, g, unknown or other
  misc_feature (517)..(517): n is a, c, g, or t
tcagcgtctagtaccacgaccggtgctcgatttagcgcgtatacaaggggggagtcagtctcagtcaggacacagcatggacatgagggtccccgctcagctccgtggggctcctgctactctggctcgaggtgccagatgtcgaccacccagttcgaccctagtcctccatccctccctgtctgcatcgtgtaggananagngtcaccatcacttcggccggaanaagtcagacgtcgttatccgaccttaatttaaagttgtatacagaacaaaacgaggaaacctcccctaacctctagacttcttagtancgacctactaccgtattgacgtaggtaggtccgggtaccagtccgaccgtcttcgacgtcggtagtacggtacgtcgtacggtaggactagttacttcctacgtcctacctacctnccgtacggtcccgtactacctaacgtagtagttactttacggaaccttaaccttaccgtactcgtaacctaacgttagtaagttacncggttaaccgttcccgggtacggtacccgggtcgaaccggggtacgggaaccgtagggtacgtaacgaactaaccggtaaccgtacgtgggtacgtacgtacgtacgacttcgttacgttcttaccgtcctttcccggttaccgtcttaccgg

SEQ ID NO: 19510 - DNA, 781 bp, Homo sapiens
  misc_feature: GYAE6OF02F81X1.14.64.F09.1.454.CMB.1.raw
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgaccggacaagtcagacgtcgttaatcgtccttaattttaaagtggttatacagacaaaaacgagggaaacgtacccctaacctctgaacttctttaggaatgacacttaccctaatttcgactaaggtacggttcgggggttaccccaagttccgaaccgttccgttacctacggttcgggacgtaacggttgggacctttcggtaacgggggaactaggttacttttaccgaccttacctacctaaccctagttacctaccggtacccggtacttacccccccgaaacgtttccgtaaaacggtttagtttttacgaaccttaaaccgtttaccgttaacgttcgtaacctaaacgttgtaacggtttaactacggttaacccgttaaccccggtacgggttaaccggtttacccgggaccgggtaaccggggtaacccgggtaaagggtacgggtaacgtaacgtaaccggtaaacgtaaccggttaggtaacgggtacgtacccggtaaccaccgttaacttccggttacgttaccgtttactaccggtttaccccttacccgtaaccg

SEQ ID NO: 19511 - DNA, 661 bp, Homo sapiens
  misc_feature: GYAE6OF02I1XN9.14.64.F09.1.454.CMB.1.raw
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagcgtctagtaccacgaccggtgctcgatttagcgcgtatacaagggggagtcagtctcagtcaggacacagcatggacatgagggtccccgctcagctcctgggggctcctgctactctggctccgaggtgccagatgtgacacccagttgacccagtctccatcctccctgtctgcatctgtagngacagngtcaccatcacttgccganatcaggancgttacncgtcctaatttaattgtatcagacaaaacgacggaanccccctaaccgtccngtacttctttgatcgactacgtcctaattttgactagagggttccgggtaccagttcgacgtcttccacgtggacgtagtggtcctcgtagggactaggtactttcgaccttactaccacctactcgtacggtccggttaccacccgtaaaccgtcgtaaacgttgtttaccggtaactaaccgttttaccgttaacttagttaacctaacgtaacggttaagtttacgtactaccggttaccccggttagggtaccggttacccgggaccgtaccggggtaaccgaagggttacgagggaactaccggtaacgacgtcggcggtacctacgaccgtaaccacgtttcgtacttaccttctccgttacctccccgttacc

SEQ ID NO: 19512 - DNA, 982 bp, Homo sapiens
  misc_feature: GYAE6OF02GF0KD.14.64.F09.1.454.CMB.1.raw
  modified_base (229)..(229): a, c, t, g, unknown or other
  misc_feature (229)..(229): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctcgaggtgccagatgtgacaccctagttcgacccagtcctccatccctccctgtctgcatctggtagagacagtacgtaccacacttcgtacttcggaccggaanaacgtcagagtcgtttagcgtaccttaagtttaattggtactacgagtaaaccaaaaaccggaacgggaaaccacccccttaaccctcgttagtattccgttttagacgtacgactacctaccgtagtttcacgaggtaccgggtccgggtaccctaagtaccctaccgtccttacgtacgcggtcaggttcggccgtggtacggacgtaacgttacgtttaccaccgtttaccgtacctacccgtaacgttccgtaccggttaccccggtacccgttaaccccgttaaacccggttagtttaaaacccggttttcgttttaaaccgttaaaccccgtttaaacccgttttaccgtttaaaccggttaccgttaaaacccggtaaaccggttaacggtttaaacgggtttaaccgttttaaccgggtttaaacccccggttaaaccccggggttttaccgggggttaaaacccccgggtttccggggaaacccgggggtttaaaacccgggggttaaccggggtaaaacgggttacgggtaaaaccgtaaccggtttaaaccccggtaaaacggtttaccggttccgggggtttaacccgggtaccggttaaaccccgggtaaaccccgtttaaaccccgggtttacgggtttttaaccccctttaccccgggggttttttaaacccctttaacccccggggtttttaaccccttttaacccccccgggttttacccccgttaaaaccccggg

SEQ ID NO: 19513 - DNA, 719 bp, Homo sapiens
  misc_feature: GYAE6OF02HMYBL.14.64.F09.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (593)..(593): a, c, t, g, unknown or other
  misc_feature (593)..(593): n is a, c, g, or t
  modified_base (684)..(684): a, c, t, g, unknown or other
  misc_feature (684)..(684): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggacacagagtccaccgatccacttcgaccgganaaggtcaggagtccgtttanccgacgtttaatttaaattggtaatcgaacgtaaccaaaaaccgaagggaaacgtacccccttaaacctcccgttagtaactttccgtttagaacgtttacggacctaccggttaacctaacgtttttcgaccgtaacgggtacgggttaccgggggtacccccttaaggtaccctaaccggttcccgtttaacgtaaccccggttggtaacccgtaacgggtcggtaccgtcggtttacgggaacgtacggttactttccgaccttacttccaacgtcttacgacggtccgtacctaaccgaacctgtaacttcgtttacaccttaacgtctagtctacacgttagaacttnacggtactaccggtacggttccgtacggcggaacgggacgaaggtacggacgtacacgtaacgtacttacgggtactcctacgaccgtacncgttactcgttccttacgtcctaccttaccgtacg

SEQ ID NO: 19514 - DNA, 748 bp, Homo sapiens
  misc_feature: GYAE6OF02GJBJO.14.64.F09.1.454.CMB.1.raw
tcagcgtctagtaccacgaccggtgctcgatttagcgcgtatacaagggggagtcgagtctcagtcaggacacagcatggacatgaggtccccgctcagctcctggggctcctgctactcgtgctcgagtgccagatgtgacaccctagttcgacccagtcctccatccctccctgtctgcatctgtaggagacagacgtcaccatcacttcgccggacagtcagagtacgttatcgaccttatttaaattcggtaatcgaagaacctaaaaacgacgggaaacctacccccttaaccgtcctgtaacttcgtttagatcgactactaccctaattcgacgtagtacggtcgggtacccagttccgaaccgtctttaccgaccgttggactacggttcgtcttcggtagggaactagttaccttcgtacctaccgtccacctagtaccgacgtccgttacctaacccgtaacttacggtaagttctttacgacccgttaaacttacccgttagttaccgtaaacaacggttaagttacgttacgtacgtaacccggttacccggttagggtacccggtttaccggaaccgggttacgggtaacccgtaaggggtacgtaaaccgtaagttaaaccccggtaagttaccggtacggggttccgtaaccgtaccgtaacccgttaaccgtaacgtttccttaacggttttacccgtacccgttacccgtttaccccgtttacccgtaccg

SEQ ID NO: 19515 - DNA, 762 bp, Homo sapiens
  misc_feature: GYAE6OF02FJ2AN.14.64.F09.1.454.CMB.1.raw
  modified_base (187)..(187): a, c, t, g, unknown or other
  misc_feature (187)..(187): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatcgtgaccacccagttcgacccagtctccatcctccctgtctcgcactntgtaggacgacagcgtcacctatcacttggccgtaacaacgtcaggtacgtcgttatcccggtaccttaagttttaaacgttcggtaacttccgaacggtaacctaaaaaaccccggaaggggtaaacctcccccccttaaaaccgtcccttagtacctttaccgttttagaacgttcgaacctacttaaccgtaacgttttaggacctaagggttacgggttcccggggttaaccctacgtacccgtaccggttaccttaccgtaccgttggactaggtcgccgttcggtaacggacttacggtactttaccnctctaccctacncctgtacgtccgtacctacccgaaccgtcgtaagttcctttacgtacttaaccgttacctacgttacgacctaacgtacgtagttacgtaccgtacccggttacccggtacggtaccggttaccgaccgggaacgggtaccggtaacggtacggaacgtacgaaccgtaacgtacgtcggtacggtacgtacgtaccgtacctacgttcgttacggttccttacgggtaccttacccgtacccgtaccg

SEQ ID NO: 19516 - DNA, 705 bp, Homo sapiens
  misc_feature: GYAE6OF02ISEM7.14.64.F09.1.454.CMB.1.raw
  modified_base (274)..(274): a, c, t, g, unknown or other
  misc_feature (274)..(274): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccgaggtgccagatgtgacacccagttgacccagtctccatcctccctgtctgctatctgtaggagacagagtcaccatcacttgccggacaagtcagagcgttatcgacttatttaattggtatcagacaaaaaccgagggaaaccnccccctaacctcctgacttctttagaatgactatacctaattcgacgtaggtaggttccgggtacccacgtcaccgtctttaccgaacgtggacgtaggtggtccgttacggtagggactacgttactttccgaccttcctacccaacctactaccgacggtcccggttaccctaaccccgaacgttacggtaacgtttaagttttcgaaccttaaacctttaccgttacgttacgtaactaaaccgtagttaaacgtttactacggtaaccgttccccggttacgggttacgtacccggggaccggtaacggggtaaccgtaagggtcggtaaacgtacgtaaccgaacgtacggttacggtcggtaaccgtcggaacctaccttaagttccgttacgttccttaaccgtccttcccggttaccctaccg

SEQ ID NO: 19517 - DNA, 805 bp, Homo sapiens
  misc_feature: GYAE6OF02JV0IA.14.64.F09.1.454.CMB.1.raw
tcagcgtctagtaccacgaccggtgctcgatttagcgcgtatacaaggggggagtcagtctcagtcaggacacagcatggacatgagggtccccgctcagctccgtggggctcctgctactctggctccggaggtgccagatgtgaccacccaggttcgacccagtcctccacttccctccctgtctgcctatcgttggtaggagacagagtacactatcactcggaccgactaagtcagacgtcgttacgcgtacttaagtttaattcggtatacgacgtaaaccgaaaaccggaacgggtaaaccgtacccccgtaaccgttacctacggtacttacgtttacgtacgtacgtacctacttaccgttaagtttacgacgtacgggtacgggttaccggggtacccctaacgtcctacccgttaccttcggtaaccggtcggtacgtaggtttccgggaccgttacggtaacgggtaccggttaacgttacgttttaccgaccgttaccggtaccttaaccgacgttaccggaaccggttcccgttaaacccgtaccctttaaaccggtaaggttaaccgtttacgttttaacgaacctttaacttacccgtacgttacttaaccgtaaagttacggttaaacgttacgtacggtaaccgttaccgggtaccggtacggttaccggaaccggttaaccgggtacgtacgggtacggtacgtaacgtaacgtacgttaggtacggacgttaccgataccgtacgtcgttaccgtcgttactccggttacctaccgtcccgttacg

SEQ ID NO: 19518 - DNA, 625 bp, Homo sapiens
  misc_feature: GYAE6OF02GI6Z7.14.64.F09.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (369)..(369): a, c, t, g, unknown or other
  misc_feature (369)..(369): n is a, c, g, or t
  modified_base (562)..(562): a, c, t, g, unknown or other
  misc_feature (562)..(562): n is a, c, g, or t
  modified_base (572)..(572): a, c, t, g, unknown or other
  misc_feature (572)..(572): n is a, c, g, or t
tcagcgtctagtaccacgaccggtgctcgatttagcgcgtatacaaggggggagtcagtctcagtcaggacacagcatggacatgagggtccccgctcagctcctgggggctcctgctactctggctccgaggtgccagatgtgacacccagttcgacccagtctccatccctcctgtctgcatctgtagaganagngtcacatcacttgccgacagtcagngtacgttactcgaccttaatttaagtgtatcacgaacaaaacgacggaaaccgtcccctaacctctgtaacttcgttgactacgctacgtacttaagttgcgtaaggtacggtccgggtacctactcgtacgtcctacgtcgtcggntacggtgtacgtcggtacggtaactagttacttacacgttcccacgacctgtccgagtcccgtactccgaagtgtaacgttagttacaccgttactatacgttataccgaagtattacggtataccggtaccttaccggtccgtacggtacccgggaggtacgggaaacgcggtaaggactaacaacgtacgngttacgggtnaccgtacgacgttacctcgttacgtcgttactcgtaccttccggtacctccgg

SEQ ID NO: 19519 - DNA, 758 bp, Homo sapiens
  misc_feature: GYAE6OF02FXACX.14.64.F09.1.454.CMB.1.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccggaggtgccagatgtgacacccagttgacccagtcctccatccctccctgtctgcatctgtaggagacagagtcaccatcacttgccgganaagtcaggagtcgttanccgacttaattttaaagttggtatcagacaaaaaaccgagggaaacncccctaaacctctagattcttgatgcatcctaatttgctagacggtcgggtacccatccacgcttcacgtcggctaggtggcctgtacgggactagtactttcaaccgttcgtaccaaccgtatccgtacggtcccgtaccttacccgaaaccgttggtaaaccgttagttttttacccgaaactttaaaccccgttttaacgttaaccgttacggtaaccctaaacggtaacggttaagttttaacggttaactaacccggtttacccccgggttagggttacccgggtttacccgggaccgggtaaacgggggtaacccgtaaaggggttacggtaagttacccgtaaaccggtaacccggttaaccggtagggtttacccggtaccgttaacgtaccccgtaacccgtttggtttacccgttacgttttaacccgttacctaacccggttttaccccctaccccgttaacccg

SEQ ID NO: 19520 - DNA, 705 bp, Homo sapiens
  misc_feature: GYAE6OF02JXTHT.14.64.F09.1.454.CMB.1.raw
  modified_base (154)..(154): a, c, t, g, unknown or other
  misc_feature (154)..(154): n is a, c, g, or t
tcagcgtctagtaccacgaccggtgctcgatttagcgcgtatacaaggggggagtcagtctcagtcaggacacagcatggacatgagggtccccgctcagctcctggggctcctgctactctggctccggaggtcgccagatgtgaccacccgngttgacccagtcctccatccctccctgtctcgctatctggtacggacgacagtacgtcacctatccacgttgacccggaacaagtccagacgtacggttactccgtacttaattttaagttaggtacttaccgaacgaaccaaaaaccgaaggggtaaaaccgtacccccttaaacgttcccgaggtaaccttcgtttcgaagtctaactacttaaccgttaagttcgacgtacggtaacgggttccgggtacccagttaccgcgtccttactacgtacggctacggtcgtcgtcggtacggactaagtccttacgactcctacaacgtctcggtacggtaccgtcctaccgaacgtataaacggttctttcgaataaccttacgtctacgtaactaagtcggtacttagtctaccgtaccgtagtaccgttccggacgtacggggaacctagggtacaacgtacgtaccgaacggtcggtaggtccggtaacgtactacccgtaactggttccgttacgtacccgttacgtaccgttccccttggaaccg

SEQ ID NO: 19521 - DNA, 850 bp, Homo sapiens
  misc_feature: GYAE6OF02I8NV7.14.64.F09.1.454.CMB.1.raw
  modified_base (176)..(176): a, c, t, g, unknown or other
  misc_feature (176)..(176): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (425)..(425): a, c, t, g, unknown or other
  misc_feature (425)..(425): n is a, c, g, or t
  modified_base (795)..(795): a, c, t, g, unknown or other
  misc_feature (795)..(795): n is a, c, g, or t
  modified_base (808)..(808): a, c, t, g, unknown or other
  misc_feature (808)..(808): n is a, c, g, or t
tcagcgtctagtaccacgaccggtgctcgatttagcgcgtatacaaggggggagtcgagtctcagtcaggacacagcatggacatggacgggtccccgctcaagctccgtggggcctcctgctactctggtacctcggaggtcgcctagatggtcgaccacccgtagttccgaccngtcctccactcctccctgtctacncgatcgagtagganacgagactacctacactactacgttcggaccgactagtacgagtacgtcttactcgtacttaagtttaagtcggtaacaacggacggaaacctaaaaacggaacggtaaacccgtacccccttaacctaccgttagacctttacggttagacgttagacttacttaacctaagtttcggacgtaagggtaccgggttaccggtaacccctnttaccgacccggtaccctttacggaaccggttcggtaagtaccgggtttcgacccggtttcggaaacgggctttaagttaccgtttacccacccggtttaaccacgtttaaacccaacgggtcccggttaaccggttacccggacctttaaaccccggtaaccgtttaaggttacggtttaattaccccggtaaactttaccttaaacccggttcttaacgaacgtaaccgtagtttaaaccgtctaaaccggttacccgggttccggttaaacggttcccgggtaccgtaaaccgggggtaacgtaaaccgggtaccggtaaaggtacgtaaccgaaacggtacccgttagacggtttacgaccgtacnccttaaccggttnttacgtccgttaccttacgtaccccttaccggttcctaaccg

SEQ ID NO: 19522 - DNA, 748 bp, Homo sapiens
  misc_feature: GYAE6OF02HM35A.14.64.F09.1.454.CMB.1.raw
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (687)..(687): a, c, t, g, unknown or other
  misc_feature (687)..(687): n is a, c, g, or t
tcagcgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttcgacccagtcctccatccctccctgtctgcattctggtaggagacagagtcaccatcacttaggaccganaagtnagagtacgttactccgtacttaatttaaattggtaatacaacgtaacgaaaaaaccgaaggaaaccgtacccccttaaaccgtcctagtaacttccgtttagtactcgtactactaccgttaagtttcgacgtaaggtacggttaccgggtaaccctagtaccgtacgtaccttacgtaacgtcggaccgtaggtcggtacgttcggtacggacgtaagttaacctttccgaaccttacccgtaaccaccgttaacgtaccgtaaccggttaccgttacccgtaacccgtaaaccgtagttaaacgttacgttttaccgaactttaaaccttacgtaaccttaacgttaccgaaacgttaacggtattaacgtaccggttacccgttacccgggtacggttaccgggtaccggaccgggaacgggtaaccgaagggtacggaacgtaactacgtaaccgnggttacgacgtccacgtaccgtactgttcctagttaccttacgtacctccgttaccgtacc

SEQ ID NO: 19523 - DNA, 787 bp, Homo sapiens
  misc_feature: GYAE6OF02HSCAT.14.64.F09.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
tcagcgtctagtaccacgaccggtgctcgatttagcgcgtatacaaggggggagtcagtctcagtcaggacacagcatggacatggacgggtccccgctcagctccgtggggctcctgctactctggcctccggaggtcgccagtatggtacgacctacccgagttcgaccctagtcctccactccctccctgtctcgctatcgtaggtacggacgacagcgtaccaacntccagtcgaccggaanacgtcgagcgttcgttacncgtacctttaatttaagtggtaactcgaacgaaacgaaaaccggaacgggaaccctcccccgttaaacgtctagtacttacgttagacgtacactacttactattcgacgtaggttacgggtccggaccctagtacctacgttacctacgtcgtacggtacgtacgggtcgtacgttaccgggtagggaaccttaaggttcctttacccgtacttaccgaacacgttcgtacgtcgaccgtttacctaaccgtaacgttacgtaagtttccgttaaccgtacttaaccgttacttacgtaccgtaacgtaaactacggttaacgtacgtaaccggttaaccgtaccgggtttaccgcccggggtttaaccggccgggtaaaccggggtaccgtaacgggaacggtaacgaccgttaaacgtaaccgggtacgtttcggccgggtaccgttaaccacccgtttaaccggtctttaaccgggtttccttacgttaaccccggtcctttaccccgttaccgaccg

SEQ ID NO: 19524 - DNA, 415 bp, Homo sapiens
  misc_feature: GYAE6OF01DAI4P.25.86.H09.1.454.CMB.1.raw
  modified_base (218)..(218): a, c, t, g, unknown or other
  misc_feature (218)..(218): n is a, c, g, or t
  modified_base (337)..(337): a, c, t, g, unknown or other
  misc_feature (337)..(337): n is a, c, g, or t
  modified_base (412)..(415): a, c, t, g, unknown or other
  misc_feature (412)..(415): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggctacggtcatcgtctcctcagcctccaccaaggccccatcggtcttcccctggccgccctgctccagagcacctccgagngcacagcggcctgggctgcctggtcaaggtctacttccactgtacagtctgagcgggctgggcaaggcgcatagnnnn

SEQ ID NO: 19525 - DNA, 493 bp, Homo sapiens
  misc_feature: GYAE6OF01CMEMP.25.86.H09.1.454.CMB.1.raw
  modified_base (363)..(363): a, c, t, g, unknown or other
  misc_feature (363)..(363): n is a, c, g, or t
  modified_base (432)..(432): a, c, t, g, unknown or other
  misc_feature (432)..(432): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttgaaagtgagtcccatcaaggttcagcggcagtggatctgggacagatttcatcctnaccatcagcagcctgcagcctgaagattctgcaacctattattgtcaacatttaaggatttaacccctntactccttcggcggtaggaccaaaggtgaagatacaaacgactgtggctagcaccatctcg

SEQ ID NO: 19526 - DNA, 486 bp, Homo sapiens
  misc_feature: GYAE6OF01BOZDE.25.86.H09.1.454.CMB.1.raw
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgatccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatctgggacagatttcatcctnaccatcagcagcctgcagcctgaagattcngcaacctnttattgtacaacaatttaaggattaccctntctccttcggcgagggaccaaggtggagatcaaacgactgaggctgcacc

SEQ ID NO: 19527 - DNA, 416 bp, Homo sapiens
  misc_feature: GYAE6OF01DGMIW.25.86.H09.1.454.CMB.1.raw
  modified_base (413)..(416): a, c, t, g, unknown or other
  misc_feature (413)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaagggactacggtcatcgtctcctcagcctccaccaagggcccatcggtcttcccctggcgccctgctccaggagcacctccgagagcacagcggccctgggctgcctggtcaaggctactcactgtacagtctgagcgggctggcaaggcgacatagnnnn

SEQ ID NO: 19528 - DNA, 415 bp, Homo sapiens
  misc_feature: GYAE6OF01C1VGK.25.86.H09.1.454.CMB.1.raw
  modified_base (218)..(218): a, c, t, g, unknown or other
  misc_feature (218)..(218): n is a, c, g, or t
  modified_base (412)..(415): a, c, t, g, unknown or other
  misc_feature (412)..(415): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctcaccaagggcccatcggtcttcccctggcgccctgctccaggagcacctccgagagcacagcggccctgggctgcctggtcaaggctacttccatgtacagtctgagcgggctgggcaaggcgcatagnnnn

SEQ ID NO: 19529 - DNA, 500 bp, Homo sapiens
  misc_feature: GYAE6OF01CPLG0.25.86.H09.1.454.CMB.1.raw
  modified_base (443)..(443): a, c, t, g, unknown or other
  misc_feature (443)..(443): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatctgggacagatttcatcctcaccatcagcagcctgcagcctgaagattctgcaacctattattgtacaaactaatttaaggactttaccctntaccttccttcggcggagggaccaagggtggagatacaaacgactggtgctgcacta

SEQ ID NO: 19530 - DNA, 497 bp, Homo sapiens
  misc_feature: GYAE6OF01ALRFL.25.86.H09.1.454.CMB.1.raw
  modified_base (400)..(400): a, c, t, g, unknown or other
  misc_feature (400)..(400): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagtatttcatccctcaccatcagcagcctgcagcctgaagnttctgcaaccttattatagtcaataatttaaggactttaccctctcctcttcggccggaggaccgaggtggagatcgaaacgactgtgctgcactac

SEQ ID NO: 19531 - DNA, 623 bp, Homo sapiens
  misc_feature: GYAE6OF01E56ZM.25.86.H09.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (596)..(596): a, c, t, g, unknown or other
  misc_feature (596)..(596): n is a, c, g, or t
  modified_base (598)..(623): a, c, t, g, unknown or other
  misc_feature (598)..(623): n is a, c, g, or t
tcagactgtacagtcacgaccggtgctcgatttagtgctatagacttgggtttgggagaagaacctactatgcagactctgtgaagggtcattcaccacctccagagacaacatcaagaacctccctgtatctgacaaatggacagtctgacacctgatgacctaccgtcttagttattagtggtagtggaaaggcggtgttgaggtgactcgcctcggaccccgngtcagctactctcacgnggtcggcgtacggtagggaacaaacgggtcctacggtctaccgttccgtcctcccaccgaccgtcccctaccgaacccggtaccggtccccttccggtccccggttccccgttccccggaggcccctccggtccgaccgaccggaacggcccgaccctaccgaccggaagtcccgaccggtaaccggtcccgggtcccggtcccggttacgggtcccgttacggtacccggttacggtaaaccgtaaccggtttaccccttaaacgtcccgtacggtttacgggaaccgttacggggtacggaccggggacggtccgggggacgacgggaacccggttaaggccagtttaagngnnnnnnnnnnnnnnnnnnnnnnnnnn

SEQ ID NO: 19532 - DNA, 541 bp, Homo sapiens
  misc_feature: GYAE6OF01ADM2V.25.86.H09.1.454.CMB.1.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (499)..(500): a, c, t, g, unknown or other
  misc_feature (499)..(500): n is a, c, g, or t
  modified_base (502)..(504): a, c, t, g, unknown or other
  misc_feature (502)..(504): n is a, c, g, or t
  modified_base (506)..(506): a, c, t, g, unknown or other
  misc_feature (506)..(506): n is a, c, g, or t
  modified_base (509)..(510): a, c, t, g, unknown or other
  misc_feature (509)..(510): n is a, c, g, or t
  modified_base (517)..(541): a, c, t, g, unknown or other
  misc_feature (517)..(541): n is a, c, g, or t
tcagactgtacagtcacgaccggtgctcgatttagtgctatagacttgggtttgggtagaagaacctactatgcagactctgtgaagggtcgattcaccacctccacgagacaacatcaagaactccctgtatctgcaaatcggacacgtctgacacctgatgacaccgccttgtacttattgtgtgaaaggtcggtgttggaggtgaactgccgtcgaacccccggcggtacgacgcactacttctacagtgggcgtcgtaggggacaaagggctaacggtcattccgtctccctcgtacnccctaccaaccgaacgggcccccaagttccgggttaccctttccccccgtggcccgccccgtagcctccagggacncaccccttccggagacgaccacgacggccggtcccgtggggccacgtcccgttagggttaacgacttacccgtcctactcgtacagtctcgaggcgggctggacaaggcgtcgattagctnncnnngngcnnctgcaannnnnnnnnnnnnnnnnnnnnnnnn

SEQ ID NO: 19533 - DNA, 669 bp, Homo sapiens
  misc_feature: GYAE6OF01DFY13.25.86.H09.1.454.CMB.1.raw
  modified_base (402)..(402): a, c, t, g, unknown or other
  misc_feature (402)..(402): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctaggtcgggtcattggcagtgtctttagcctggtatcagcgaagaaacccgaggggaacgctacctaagctcctgtatcgttgactgccgttactaggtttggaaagtcggacgtccagtcgaaaggttcaggcggcagtggagtcgtgggtacagtacttcactcctaccacatcgacncgacgcgtacgcacgtaccgtagtaacgttcttacgtactaaccttaactttaatttacgttaacgttaaacctaaacgttttaaaacgtttaccggttaaaccctttccccgttaccgttcccggttacccgggttaccggggaacggggtaaaccgggtaacggtaaacggggtacggtaacggttaaaccgtaacggtaaaccggtaaacggttcgggtaccggttacgaccgttaacccgtaccttacgttcgtttaaccccg

SEQ ID NO: 19534 - DNA, 630 bp, Homo sapiens
  misc_feature: GYAE6OF01DWUBE.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcgggctaggtcgggtcattggcagtgtctttagcctggtatcagcagaaaccgaggggaagctacctaagctcctgattcttgatcgcctctagtttggaaagtggagtccatcaaggtcagcgcagtgatcgtgggacagtatttcactcctacacatcagcagcctgcacgtcctagaacgtcttacgtacgtacctaaacctttatttacttacgtaacctaaacgttaaacgttttaaacggtacctttaacccccttcgttaccccgtttacccggtttaccggggaccggggtaaacggggttaaacccggtaaaggggttacgggaaacggtaacgttaacccgaaaaacccgggttaacgttcgggttacgggaccttaccggtacccgtaacccgttaacg

SEQ ID NO: 19535 - DNA, 527 bp, Homo sapiens
  misc_feature: GYAE6OF01B6TGG.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatctgggacagatttcatcctcaccatcagcagcctgcagcctgaagattctgcaaccttattattagtacaactaattttaacggactttacccctcttaccttccgttacgggccgggaagggacccgtaagggttaggacgaataccgaaaacgacgtggtacggctggccacgtac

SEQ ID NO: 19536 - DNA, 525 bp, Homo sapiens
  misc_feature: GYAE6OF01BSRAZ.25.86.H09.1.454.CMB.1.raw
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (450)..(450): a, c, t, g, unknown or other
  misc_feature (450)..(450): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagatttcatccctcaccatcagcagcctgccagcctagaagtattcngctaaccttnttacttgtacaaactaatttaaggctttaccctnttacctccgttcggacggtagggacccgtaagggtggagtactacgaaacgtaactgtacggactcgcgacccta

SEQ ID NO: 19537 - DNA, 546 bp, Homo sapiens
  misc_feature: GYAE6OF01BW47A.25.86.H09.1.454.CMB.1.raw
  modified_base (353)..(353): a, c, t, g, unknown or other
  misc_feature (353)..(353): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctacctaagctcctgatctttgatgcctccagtttggaaagtggagtcccatcaaggttcagcggcagtgatcngggacagtatttcatcctcacatcagcagctgcagcctagaagtattctgacctaacctattatagttacaaactaagttttaagaactttacccctacttccttacccggttacggaccgggaacgggtaacccgaagggtcggaaggtactacgaaaacggtacgtacggtgaccttcgccgtaacctacg

SEQ ID NO: 19538 - DNA, 519 bp, Homo sapiens
  misc_feature: GYAE6OF01E2JYP.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatctttgatgcctcagtttggaagtggagtccatcaagttcagcggcagtggatcgtgggacagtatttcatcctcaccatcagcagcctgcagcctagaagtattcctgacctaaccttattattagtactaaactaattttaaaggactttaccctcttctcccgttcgggacggagggaccgtaagggtggaagataccaaacgactggtcggctcgcacgtac

SEQ ID NO: 19539 - DNA, 503 bp, Homo sapiens
  misc_feature: GYAE6OF01BKIRY.25.86.H09.1.454.CMB.1.raw
  modified_base (499)..(499): a, c, t, g, unknown or other
  misc_feature (499)..(499): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtccatcaagttcagcggcagtggatcgtgggacagatttcatcctcaccatcagcagcctgcagcctagaagtattctgcaacctattattagtacaactaatttaaggacttaccctctcttccgttcggcggagggaccaagggtggagatacaaacgacgtgtaggctcgcnctac

SEQ ID NO: 19540 - DNA, 432 bp, Homo sapiens
  misc_feature: GYAE6OF01ATMB2.25.86.H09.1.454.CMB.1.raw
  modified_base (421)..(432): a, c, t, g, unknown or other
  misc_feature (421)..(432): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggacccccgcggtcagcactacttctacatgggcgtctggggcaaagggactacggtcatcgtctcctcagcctccaccaagggccccatcggtcttccccctggcgcccctgctccaggacgcaccctccgagagcaccagcggccctggggctcgcctggtcaaggacctactttccactgacagtctgagcgggctggcaaggcgcatagnnnnnnnnnnnn

SEQ ID NO: 19541 - DNA, 425 bp, Homo sapiens
  misc_feature: GYAE6OF01DHL4O.25.86.H09.1.454.CMB.1.raw
  modified_base (218)..(218): a, c, t, g, unknown or other
  misc_feature (218)..(218): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (417)..(425): a, c, t, g, unknown or other
  misc_feature (417)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatggggcgtctggggcaaagggactacggtcatcgtctcctcagcctccaccagggccccatcggtccttcccctggcgccctgctccaggacgcacctccgagacgcacngccggccctgggctgcctggtcaaggctacttcatgtacngtctgagcgggntggcaaggcgacagtagnnnnnnnnn

SEQ ID NO: 19542 - DNA, 417 bp, Homo sapiens
  misc_feature: GYAE6OF01ERYJL.25.86.H09.1.454.CMB.1.raw
  modified_base (218)..(218): a, c, t, g, unknown or other
  misc_feature (218)..(218): n is a, c, g, or t
  modified_base (414)..(417): a, c, t, g, unknown or other
  misc_feature (414)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggcccatcggtcttcccctggcgccctgcctccaggagcacctccgagagcacagcggccctgggctgcctggtcaaggctacttccactgtacagtctgagcgggctggcaaggcgcatagnnnn

SEQ ID NO: 19543 - DNA, 415 bp, Homo sapiens
  misc_feature: GYAE6OF01BOYAC.25.86.H09.1.454.CMB.1.raw
  modified_base (411)..(415): a, c, t, g, unknown or other
  misc_feature (411)..(415): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctcaccaagggcccatcggtcttcccctggcgccctgctccagagcacctccgagagcacagcggccctgggctgcctggtcaaggctacttccactgtacagtctgagcgggctggcaaggcgcatagnnnnn

SEQ ID NO: 19544 - DNA, 416 bp, Homo sapiens
  misc_feature: GYAE6OF01E4I2W.25.86.H09.1.454.CMB.1.raw
  modified_base (413)..(416): a, c, t, g, unknown or other
  misc_feature (413)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatcggtcttccccctgcgccctgctccaggagcacctccgagagcacagcgccctgggctgcctggtcaaggactacttccactgtacagtctgagcgggctggcaaggcgcatagnnnn

SEQ ID NO: 19545 - DNA, 539 bp, Homo sapiens
  misc_feature: GYAE6OF01DUPPF.25.86.H09.1.454.CMB.1.raw
tcagactgtacagtcacgaccggtgctcgatttagtgctatagacttgggtttgggggcaagggaggtcagacccactcaggacacgagcatggacatgagggtccccgctcagctccctgggcttctgctgctctggctcccaggtgccaaatgtgccatccagttgacccagtcctccatcctccctgtcctgcctctgttccgagacatagtcaccatcacttgtcgggctagtcggtcattggcagtgctttagcctggtatcagacagaaaccagggaacgctcctaagctctgatcttgatgcctcagtttggaaagtgagtccatcaaggttcaggcgcagtggatcgtagggacagtattttcgacttcctcacctagtcagcagcctgcagcctagaagtatttctgacctaacttattattgtacaaacgtaatttaaggacttacccgttcttccgttccgttcgggacggtagggaccgaagggtaggacggtactacgaaacgacgtgtacggctcgcctacgtac

SEQ ID NO: 19546 - DNA, 492 bp, Homo sapiens
  misc_feature: GYAE6OF01CHSXD.25.86.H09.1.454.CMB.1.raw
  modified_base (279)..(279): a, c, t, g, unknown or other
  misc_feature (279)..(279): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtcccatcaaggttcagcggcaggtggatctgggacagtatttcatcctcaccatcagcagcctgcagcctgaagattctgactaacctattattgtacaactaatttaagacttaccctctctccttcggcggaggacaggtgagatacaaagactgtagntgcncta

SEQ ID NO: 19547 - DNA, 645 bp, Homo sapiens
  misc_feature: GYAE6OF01BDIH8.25.86.H09.1.454.CMB.1.raw
tcagactgtacagtcacgaccggtgctcgatttagtgctatagacttgggtttggggggagtcagacccactcaggacacagcatggacattgagggtccccgctcagctcctggggcttctgctgctctggctcccaggtgccaaatgtgccatccagttgacctagtctccatcctccctgtctgcctctgttcgagacatagtcgaccatcacgttgtcgggctagtcgggtcattggcagtgctttagcctggtatcagcagaaaccaggggaagcctctaagctcctgatctttgatgcctcagtttgaaagtggagtcccatcaaggttcagcggcagtggatcgtgggacagtatttcattccacaccatcagcacgccctagcctagcctagaacgtattcagacctaaaccttagttacttcggtaacctaaaccgttaaagttttaaacgggtacctttaacccccttcgttacccgttaccgtttaccggggccggtaaaccgggtaaccccgtaaaggggttccgggtaaacgtaacgttaacccggttaaaaacccgggtaaacccgttagggtttacccgggtaccgtttaaccgggacccttaaccccgtaagtttcccggtttacccgg

SEQ ID NO: 19548 - DNA, 628 bp, Homo sapiens
  misc_feature: GYAE6OF01CAUWQ.25.86.H09.1.454.CMB.1.raw
  modified_base (274)..(274): a, c, t, g, unknown or other
  misc_feature (274)..(274): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgtccatccagttgacccagtctccatcctccctgtctgcctctgttcgagacatagtcaccatcacttgtcggctagtcgggtcattggcagtgctttagcctggtatcagtcagaaccaggganctcctaagctcctgatctttgatgcctcagtttggaaagtgacgtccatacgaagttcagtcggactagtggatcgtggacagtatttcatcctcacatcagcacgcctagcacgtacctgtaactactttctcgacctaaaccttatttaacgttagtaacctaaacgttaaacgttttaacgggtaacctttaccccgtaccgtttacccgttacccgtttaccgggaccgggtaacgggtaaccccgtaaaggggttcgggtaaacgtaacgttaaacccggaaaaaccggttaacgttagggtaccgggtacccttacggtaaccctacccggttaattcggtttacccg

SEQ ID NO: 19549 - DNA, 456 bp, Homo sapiens
  misc_feature: GYAE6OF01A0T1X.25.86.H09.1.454.CMB.1.raw
  modified_base (218)..(218): a, c, t, g, unknown or other
  misc_feature (218)..(218): n is a, c, g, or t
  modified_base (443)..(456): a, c, t, g, unknown or other
  misc_feature (443)..(456): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggccccatccggtccttcccccgtggccgcccctgcctccgaggacgccacctccgagacgcacgacgccggcccgtggggcctgcccgtggtaccaagggtacctaccttccactgtacagtctgacggcgggctgggacaaggcgcatgnnnnnnnnnnnnnn

SEQ ID NO: 19550 - DNA, 528 bp, Homo sapiens
  misc_feature: GYAE6OF01CGTGV.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagtttggaagtggatccatcaaggttcagcggcagtgatctgggacagatttcatcctcacatcagcagcctgcagcctagaagtattctcgactaaccttattattacgtactaaacttaagtttaacggtacttaccctcttaccgttcccgttacgggccggtaagggaccgaagggtaggaacgtataccgaaacgtacgtggtcggatcgcacgtac

SEQ ID NO: 19551 - DNA, 768 bp, Homo sapiens
  misc_feature: GYAE6OF01CXNAI.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtaccactactactcgttcggtcgtacgtcgggtcgtactggtcgacgtagtcgtttacgttcgtcggttagtacacgacgacgaaacgaacgggaagggactacctacgtactccttcgtagtctttcgttagtcgtccgttccgtaacggtttagggttaaaggtaacgggtacggtacccgtaaccgtacgtaacggttacggtacggacggacggtacggtacgggtagtaccgttagggacggtaacgttaagtttacttacctaccttaccctaaccgaacttcgacgacgacgtcctcgacgacgaccgttacgtaaagtacgtttctccggaactaaccctttaatttagttgtaaccgtaaaaccttaagttttaaacggtaccttttaccccttccccttcggttacccggtttaccggggtaccgggggaaacggggttaacccgaaacgggggttacgggtaaggtaaacttaacccggttaaaaccgggaaacccgttttgggacgggttacccggtactaaacccggtacccctacggttttacccgg

SEQ ID NO: 19552 - DNA, 581 bp, Homo sapiens
  misc_feature: GYAE6OF01BSJPH.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatcgcctctagtttggaaagtggagtccatcaaggttcagcggcagtgatcgtgggactagtattcactcctacaccatcagcagcctgcacgcctagaacgtattcagtacctaaaccgttatttactacgttactaaactaagttttaacggtaactttacccctcttacccgttaccgttaccggggaccggtaaacgggaccgtaaggggttaggaacgtacgtaacccgtaaaacggtacgttcggtacgggtacttcggaccctaaccgttaacg

SEQ ID NO: 19553 - DNA, 459 bp, Homo sapiens
  misc_feature: GYAE6OF01CSQRC.25.86.H09.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
  modified_base (455)..(459): a, c, t, g, unknown or other
  misc_feature (455)..(459): n is a, c, g, or t
tcagactgtacagtcacgaccggtgctcgatttagtgctatagacgttggggtttgggagaagaacctactatgcagactctgtgaagggtcgattcaccacctccagagacaacatcaagaacctccctgtatctgcaaatggacagtctgacacctgatgacaccgccttgtattattgtgtgaaggcggtgttgaggtgaatgcctcggaacccccgnggtcagctactacttctacagtgggcgtcgtgggggacaaagggctacggtcactcgtctcctcacgccctaccaaccgaacgggccccaagttccggtccctttcccccgngggcccncccctgcctccgaggacgcctaccctccgagacgcacncgccggccctgggctagccctggccaaggtcctacttccactgacagtctggagcgggntgggcaagggcatatagnnnnn

SEQ ID NO: 19554 - DNA, 597 bp, Homo sapiens
  misc_feature: GYAE6OF01D7EAN.25.86.H09.1.454.CMB.1.raw
  modified_base (397)..(397): a, c, t, g, unknown or other
  misc_feature (397)..(397): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgtctttagcctggtatcagcaagaaaccgaggggaagctacctaagcctcctgtattctttgactcgtcctacgtaggtttaggaaagtggacgtcccatcgaaggttcagtcggcaggtggatcgtggactagtatttcgatcctcaccntcacgtcacgtcctgaccacgtaccgtagaacgtactttccgacgtaacctaaccttattacgttacgtaacctaaacttaaacgttttaacgtactttaccccttcttccctccggttcgggaccggtaacgggtaaccgtaagggttaggaacggtactaacgaaaccgtacgttcgggtcgactcgaccacgttacg

SEQ ID NO: 19555 - DNA, 421 bp, Homo sapiens
  misc_feature: GYAE6OF01B1W8B.25.86.H09.1.454.CMB.1.raw
  modified_base (416)..(421): a, c, t, g, unknown or other
  misc_feature (416)..(421): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatcggtcttcccctggcgccctgctccaggacgcacctccgagagcacagccggccctggggctgcctggtcaaggctacttccactgtacagtctgagcgggctggcaaggcgcatagnnnnnn

SEQ ID NO: 19556 - DNA, 468 bp, Homo sapiens
  misc_feature: GYAE6OF01AQ95V.25.86.H09.1.454.CMB.1.raw
  modified_base (444)..(468): a, c, t, g, unknown or other
  misc_feature (444)..(468): n is a, c, g, or t
tcagactgtacagtcacgaccggtgctcgatttagtgctatagacttggggtttgggagaagaacctactatgcagactctgtgaagggtcgattccaccacctccacgagacaacatcaagaactccctgtatctgcaaatggacagtctgacacctgatgacaccgccttgtattattgtgtgaaaggcggtgttgaggtgaatgcctggaacccccgcgggtcagcactacttctacatgggcgtctgggggcaaagggactacggtcatcgtctcctcagcctccaccaagggccccatccggtcttccccccgtggccgcccctgcctccgagggacgccaccctccggagacgcacgacggccggccctggggcctgccctgggtcaacgggctacttccactgtacagtctggagcgggctgggcaaggccgcatgnnnnnnnnnnnnnnnnnnnnnnnnn

SEQ ID NO: 19557 - DNA, 416 bp, Homo sapiens
  misc_feature: GYAE6OF01A07QP.25.86.H09.1.454.CMB.1.raw
  modified_base (412)..(416): a, c, t, g, unknown or other
  misc_feature (412)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggctacggtcatcgtctcctcagcctcaccaagggccccatcggtcttccccccggcgcccctgcctccaggagcacctccgagagcacagcgccctgggctgcctggtcaaggctactccactgtacagtctgagcgggctggcaaggcgcatagnnnnn

SEQ ID NO: 19558 - DNA, 576 bp, Homo sapiens
  misc_feature: GYAE6OF01DJPPZ.25.86.H09.1.454.CMB.1.raw
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggatccatcaaggttcagcggcagtggatcgtgggacagtatttcatcctcaccatcagcagcctgcagcctgaagntttcngacctaaccttatttaattgtactaaactaagttttaacggactttaccccgtcttaccgttcccgtttacgggaccgggtaggggtaacccgtaaaggggttacggaaggtaaaccttaaccgaaaaaccggtaaccttgggtacgggtaccttacggaccctaacccgtaacg

SEQ ID NO: 19559 - DNA, 531 bp, Homo sapiens
  misc_feature: GYAE6OF01CPBYG.25.86.H09.1.454.CMB.1.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccatcacttgtcgggctagtcgggtcattggcagtgctttagcctggtatcagcagaaaccnggggaanctcctaagctcctgatctttgatcgcctccagtttggaaagtggagtcccatcaaggttcagcggcagtggatcgtgggactagtntttcactcctcaccaatcagcagcctagcagcctagaacgattcngactaaccttattactgtacaaactagtttaagactttaccctctctccgttcggcggtagggaccgtaagggtggaagtactaaccgaaacgaacgttggtacggacctgccaaccgtacg

SEQ ID NO: 19560 - DNA, 564 bp, Homo sapiens
  misc_feature: GYAE6OF01C1YRV.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccgagggaanctccaagctcctgatcttgatgcctcagttgaaagtgagtccatcgaagttcacgcggcagtggagtcgtagggactagtacttcattccctacactatcagctaggcctagccgagccgtagaagtacttctcgtactaaccttatttacttagtaacctaaacttaagtttaacggactttaaccctcgttaccgttaccgttccgggacggacggggtaaccgtaaagggtacggagtaactacgaaaaccgtacgttcggtagtcctaggcctaccgtaacg

SEQ ID NO: 19561 - DNA, 448 bp, Homo sapiens
  misc_feature: GYAE6OF01DXXVA.25.86.H09.1.454.CMB.1.raw
  modified_base (433)..(448): a, c, t, g, unknown or other
  misc_feature (433)..(448): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaaggcccatcggtcttccccctggcgcccctgctccaggacgccaccctccgagacgcacgacgccggcccgtgggctgccgtggtacgaaggacctacgttccactcgtacagtcgtgaggcgggctggcaagggcacagtagnnnnnnnnnnnnnnnn

SEQ ID NO: 19562 - DNA, 421 bp, Homo sapiens
  misc_feature: GYAE6OF01AYA2N.25.86.H09.1.454.CMB.1.raw
  modified_base (218)..(218): a, c, t, g, unknown or other
  misc_feature (218)..(218): n is a, c, g, or t
  modified_base (416)..(421): a, c, t, g, unknown or other
  misc_feature (416)..(421): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggcccatcggtcttccccctggccgccctgctccaggagcacctccgagagcacagcggccctgggctgcctggtcaaggactacttccactgtacagtctgagcgggctggcaaggcgcatagnnnnnn

SEQ ID NO: 19563 - DNA, 419 bp, Homo sapiens
  misc_feature: GYAE6OF01D1GLE.25.86.H09.1.454.CMB.1.raw
  modified_base (410)..(410): a, c, t, g, unknown or other
  misc_feature (410)..(410): n is a, c, g, or t
  modified_base (416)..(419): a, c, t, g, unknown or other
  misc_feature (416)..(419): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtccttccccctggcgccctgctccaggagcacctccgagacgcacagcggccctgggctgcctggtcaaggctacttccactgtacagtctgagcgggctgggcaaggcncatagnnnn

SEQ ID NO: 19564 - DNA, 512 bp, Homo sapiens
  misc_feature: GYAE6OF01BPYL9.25.86.H09.1.454.CMB.1.raw
  modified_base (482)..(482): a, c, t, g, unknown or other
  misc_feature (482)..(482): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgctcagtttgaaagtggagtccatcaaggttcagcggcagtgatcgtgggacagtatttcattcctcacctatcagcagcctgcagcctagaagtacttctagctaaccttattattgtacaaactaatttaacgactttaccctctacctccgttcggacggaggaccgaagggtgagtntacgaaacgacgtgaggctggcctactacg

SEQ ID NO: 19565 - DNA, 538 bp, Homo sapiens
  misc_feature: GYAE6OF01EULN0.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaagctcctaagctcctgatctttgatgcctcagtttggaaagtggagtccatcaaggttcagcggcagtggatcgtgggacagtatttcatcctcaccatcagcagcctgcagcctgaagtacttctacgactaaccgttatttacttagtacctaaactaattttaaggactttaccctcttcctccgtttccggcgggaagggtacccgtaagggtaggagtactaccgaaaacgtactggtacggactcggccacctacg

SEQ ID NO: 19566 - DNA, 425 bp, Homo sapiens
  misc_feature: GYAE6OF01CP0BH.25.86.H09.1.454.CMB.1.raw
  modified_base (218)..(218): a, c, t, g, unknown or other
  misc_feature (218)..(218): n is a, c, g, or t
  modified_base (418)..(425): a, c, t, g, unknown or other
  misc_feature (418)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggcccatccggtcttccccctggccgccctgcctccaggacgcacctccgagagcacagcggccctgggctgcctggtcaaggctacttccatgtacagtctgagcgggctgggcaaggcacatagnnnnnnnn

SEQ ID NO: 19567 - DNA, 417 bp, Homo sapiens
  misc_feature: GYAE6OF01CSVJO.25.86.H09.1.454.CMB.1.raw
  modified_base (413)..(417): a, c, t, g, unknown or other
  misc_feature (413)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaagggccccatcggtcttccccctggcgccctgctccaggagcacctccgagagcacagcggccctgggctgcctggcaaggctactccactgtacagtctgagcgggctggcaaggcgcatagnnnnn

SEQ ID NO: 19568 - DNA, 647 bp, Homo sapiens
  misc_feature: GYAE6OF01DY03O.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccactcctccctgtctgcctctgttcgagacatagtcacatcacttgtcggctaggtcgggtcagttggctagtgtcttagcctggtatcagcaagaaaccgagggagctctagctctgattctttgatcgtcctacgtagtttaggaaagtcggacgtaccatacgtaagttcgaaggtcggacgtaaggtggtactacgtaggggaactagttactttcaacttccctactacctaacgtacacggctacggtcctagcacgtaccgtaggtaacgtacttcgtacgtactaacctttaatttacgttacgtaacgtaaacttaaacgtttaacggttaaccttacccttaccttaccgttccggttaccgggtaccgggtaaacggggtaacccgtaaggggtagtaacggtaacgtaaccgtaaaacggttaacgtcggtacggtaccgtcgtacccgtaaccgttaccg

SEQ ID NO: 19569 - DNA, 487 bp, Homo sapiens
  misc_feature: GYAE6OF01BLZKY.25.86.H09.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagtttggaaagtggagtccatcaaggttcagcggcagtggatcgtgggacagtatttcactcctcaccatcagcagctgcagctganttcngcaactnttatgtacaatatttaagattaccctntctccgttggcggaagggaccaagggtgagataccgaaagactgtagctgccacta

SEQ ID NO: 19570 - DNA, 416 bp, Homo sapiens
  misc_feature: GYAE6OF01D1XS0.25.86.H09.1.454.CMB.1.raw
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (413)..(416): a, c, t, g, unknown or other
  misc_feature (413)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaaggcccatcggtcttcccctggccgccctgctccaggacgcacctccgagacgcacacgccggcctgggctgcctgtcaaggctacttcactgtacagtctgagcgggntgggcaaggcncatgnnnn

SEQ ID NO: 19571 - DNA, 620 bp, Homo sapiens
  misc_feature: GYAE6OF01BMZFC.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgagggganctcctaagctcctgatctttgatgcctcagttggaaagtggacgtccatcaaggttcagcggcaggtggatcgtgggacaggtatttcactcctacaccatcagcagcctgcagcctagaagtacttctacgacctaaaccgttatttacttagtacctaaacgttaaagttttaaacgggtaacctttaaccccgttccttacccgttcccgttacccgggtaccggggtaacggggtaaccccgtaaagggggtacggtaacgggtaaccgttaaccggaaaacccggtaaccggttacgggttacgggaccgttcggtaacccgtaacccgttaaccg

SEQ ID NO: 19572 - DNA, 420 bp, Homo sapiens
  misc_feature: GYAE6OF01C8W8H.25.86.H09.1.454.CMB.1.raw
  modified_base (383)..(383): a, c, t, g, unknown or other
  misc_feature (383)..(383): n is a, c, g, or t
  modified_base (412)..(420): a, c, t, g, unknown or other
  misc_feature (412)..(420): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtccttcccctggccgccctgcctccaggagcacctccgagagcacagcggccctgggctgctggtcaaggctactcactgacngtctgagcgggctgggcaaggcgcatagnnnnnnnnn

SEQ ID NO: 19573 - DNA, 559 bp, Homo sapiens
  misc_feature: GYAE6OF01CSOE2.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcctagtttggaaagtggacgtccatcgaaaggttcaggcggacgtagtggtatcgtagggactagtatttcatcctcacctatcagcagcctgcagcctgaagtcttctcgactaacccttatttacttcgttaactaaacgttaattttaagggactttaccctcttccgttccgttccgggacggtacgggacctaagggtgaacggacttaccgaaaaggtacgttaggtacggactcgcgtaccgtacg

SEQ ID NO: 19574 - DNA, 196 bp, Homo sapiens
  misc_feature: GYAE6OF01BKROC.25.86.H09.1.454.CMB.1.raw
  modified_base (195)..(196): a, c, t, g, unknown or other
  misc_feature (195)..(196): n is a, c, g, or t
tcagactgtacagtcacgaccggtgctcgatttagtgctatagacttgggtttgggatgccagtctgagtggtccgacggtgttcggcggagggaccaagctgaccgtcctaggtcagcccaaggctgccccctcggtcactctgttcccgccctcctcactgtacagtctgagcgggctggcaaggcgcatagnn

SEQ ID NO: 19575 - DNA, 559 bp, Homo sapiens
  misc_feature: GYAE6OF01CAKVL.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccgaggggaagctacctaagctctgatcttgatgcctcgtagtttggaaagtgagtccatcaaggttcagcggcagtggatcgtgggactagtatttcatcctcaccatcagctagcctgcagtcctagaagtacttctacgacctaaccgttattaacttagtacaagtttaaagttaacgtactttaccctcttaccttccggttacgggacgggtaacgggaccgtaaagggtggaacgattaacccgaaaacggtacgttggtacgggccttaggaccacgttaccg

SEQ ID NO: 19576 - DNA, 592 bp, Homo sapiens
  misc_feature: GYAE6OF01CSIN3.25.86.H09.1.454.CMB.1.raw
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacgctcctaagctcctgatctttgatgcctcagtttggaagtggagtcccatcaaaggttcagcggcaggtggatcgtgggacagtatttcatcccncacntacgacgcacgcctgctacgccgtagaacgtacttcgtacgacctaaacctttatttacttacgtaactaaacgttaaacgtttaacgtacctttaaccctcttacccgttccgttacggggaccgggtaacgggtaaacccgtaggggttagaacggtaactaaccgtaaaaccggtacgttacggtacggtacgtacgccgtaaccgttacg

SEQ ID NO: 19577 - DNA, 577 bp, Homo sapiens
  misc_feature: GYAE6OF01B5CVA.25.86.H09.1.454.CMB.1.raw
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaanctcctaagctcctgatctttgatgcctcagtttggaaagtggacgtccatcaaggttcaggcggcagtggatcgtgggacagtatttcatcctcaccatcagcagcctgcagcctagaagtcttcgngacctaaccttattattacgtaactaaacgttaaagttttaacggtaaccttttaccccgtcttcccttacccggttccgggtaccgggtaacggggtaacccgtaaggggttaggaacgtaacgtaccgtaaaacgtaacgttggtacgggcctacggccctaaccgtacg

SEQ ID NO: 19578 - DNA, 682 bp, Homo sapiens
  misc_feature: GYAE6OF01AVWNI.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcaggcggcaggtggatcgtgggacaggtatttccattccctacacctatcagcagccctgacgacgcctagaagtactttcacggtacctaaaccctttaagtttactttacggttaccctaaaacgtttaaaacgttttaaacggggtaaccctttttacccccgttacctttaccccgtttaccccggttttacccggggggtaccggggtaaaccggggggtaaaccccgttaaaggggggtttaccgggaaacgggtaaacccgttaaacggaaaaaacccgggttaacccgtttaggggttaccgggtaccgttacggtacccgtaaaccccgttaaaccgg

SEQ ID NO: 19579 - DNA, 571 bp, Homo sapiens
  misc_feature: GYAE6OF01BXJ4Z.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagctcctaagctcctgatctttgatgcctcagtttggaaagtggagtccatcaaggttcagcggcagtggatcgtgggacagtatttcattcctcactatcagcagcctgcagcctagaacgtattctgactaaccttagttacttcgtaacaaacttaagttttaacggactttaccccctattcccgttacccgttacgggccgggtaacggggaacccgtaaaggggttaggaacgtaactaaccgaaaaacggtaccgttggtacgggaccttaggcctaaccgtacg

SEQ ID NO: 19580 - DNA, 417 bp, Homo sapiens
  misc_feature: GYAE6OF01CAG95.25.86.H09.1.454.CMB.1.raw
  modified_base (217)..(217): a, c, t, g, unknown or other
  misc_feature (217)..(217): n is a, c, g, or t
  modified_base (413)..(417): a, c, t, g, unknown or other
  misc_feature (413)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtattgagtgaatgcctggaacccccgnggtcagcactacttctacatgggcgtctggggcaaagggactacggtcatcgtctcctcagcctccaccaagggcccatcggtcttcccctgcgccctgctcaggagcacctccgagacgcacacgcggccctggggctgcctggtcaaggactacttccactgtacagtctgagcgggctggcaaggcgcatagnnnnn

SEQ ID NO: 19581 - DNA, 515 bp, Homo sapiens
  misc_feature: GYAE6OF01AO5GH.25.86.H09.1.454.CMB.1.raw
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtccatcaaggttcagcggcagtggatctgggacagatttcatcctanaccatcagcagcctgcagcctagaagtattcngacaaccttattattagtacaaactaagtttaaggactttaccctctccttccgttcgggacggtagggacctaagggtgaagatacgaaacgactgtacggctcgcaccta

SEQ ID NO: 19582 - DNA, 604 bp, Homo sapiens
  misc_feature: GYAE6OF01DDU3W.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctttctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtcccatcaaggttcagcggcagtggatcgtgggacagtatttcatcctcaccatcagcagcctgcagcctagaacgtattctagactaaccttatttattcgtaactaaacttaagtttaaacggtacctttaaccccgttcttacccgttcccggtttaccggggaccgggtaacggggtaacccgtaaaggggttacgggtaacggtaacgttaaccgaaaacccggttaacgttacgggttacggtcccgttaggaccctaaccgtacgtttacccgg

SEQ ID NO: 19583 - DNA, 554 bp, Homo sapiens
  misc_feature: GYAE6OF01CMIL2.25.86.H09.1.454.CMB.1.raw
tcagactgtacagtcacgaccggtgctcgatttagtgctatagacttgggtttgggggcaggagtcagacccactcaggacacagcatggacatgagggtcccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagcctggtatcagcaagaaaccgaggggaagctcctaagctcctgatcttgatcgcctcagttggaaagtggatccatcaaggttcagcggcaggtgatcgtagggacagtattcatcctcaccatcagcacgctgcagcctagaagtacttcgtgactaaccttattactgtactaaactaatttaagactttaccctcttaccgttccgttacgggaccgggtacggggaaccctaaggggtaggtaagtaacgtaccgaaaacggacgttagggtacggaccgtacgccgtaaccgtaacg

SEQ ID NO: 19584 - DNA, 620 bp, Homo sapiens
  misc_feature: GYAE6OF01BBYXW.25.86.H09.1.454.CMB.1.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccatcacttgtcgggctagtcgggtcagttggcagtgtctttagcctggtatcagcaagaaccgagggaacnctcctaagctcctgtattcttgatcgcctctaggtttaggaaagtggtacgtccctatacgtaacggttcgacggcggactaggtaggtactcgtaggggactaaggtactttaccacttcccttacaacccgtataccgaacgccaacgcctcgaccacgtccgtaagaacgtcgtttctacgtacctaaccttagttacttacggtaactaaacgttaagttaacgtacctttacccgtcttaccgttcccggttcggacgggtaacggtaaccgtaagggtaggaacgtacgtaaccgaaaccgtacgttggtacggactcggtacctacgttacg

SEQ ID NO: 19585 - DNA, 718 bp, Homo sapiens
  misc_feature: GYAE6OF01DQFAF.25.86.H09.1.454.CMB.1.raw
  modified_base (205)..(205): a, c, t, g, unknown or other
  misc_feature (205)..(205): n is a, c, g, or t
tcagactgtacagtcacgaccggtgctcgatttagtgctatagacgttgggtttgggggcaggagtcagacccactcaggacacagcatggacatgagggtccccgctcagctcctggggcttctgctgctctggcctcccgaggtgccaaatgtgccatccagttcgacccagtctccatccctccctgtctgcctctgtcganacatagtcaccatcacttggcggtcttaggtcgggtcagttggactagtgtctttagcctggtatcagacaacggaaaccgaggggaactcctaccgtaacgccttaccgtggtactttcgtttacgacgttcgtacccttaccggttaaggttttacgggaaaacgttcgggacttaccccgaagttacggtaaacgggttcgaacggccggtctaagggtcgtatccggtagggaactaggtactttcactccctacacctatcgaggctaacgcctgaccgacgtacctaagtaacgtactttcacgtaacctaactttaatttacgttacgtacctaaaacgtttaacgtttaaacggtacccttttaacccgtcgttcccggttaccggttaccggggaaccgggtaaacggggtaacccggtaaagggggtagtaaccggtaaacttaccgggaaaaacgttcggttacgggttaccggaccgtttaccggaccctaaccgttaccg

SEQ ID NO: 19586 - DNA, 641 bp, Homo sapiens
  misc_feature: GYAE6OF01COIZI.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcgggctagtcgggtcagttggcagtgtctttagcctggtatcagcaagaaaccgaggggaanctacctaagctcctgtatctttgatcgtcctcgtaggtttaggaaagtggacgtcccagtacgtaaggttcaggcggcaggtggtatcgtagggactagtactttcactcctacacctatcacgcacgcctgacgacgccgtagaagtacttcgtacgacctaaccttatttaacttacgttaactaaacgttaacgtttaaacggtacctttaccctttaccgttaccgttacccggttcggggtaaccgggtaaccggggtaaacccggtaaaggggtacggtaaacgtaacgtaaccggtaaaaacggtacggttacgggtacggtaccgtacgtaccctaaccgtgttccgtttacg

SEQ ID NO: 19587 - DNA, 560 bp, Homo sapiens
  misc_feature: GYAE6OF01AZYOE.25.86.H09.1.454.CMB.1.raw
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccgggggggtccctgagactctcctgtgtagcctctggattcatgtttgatgattatgccatgcacgtgggtccgtcgaacgggtccggggaaggtcgtgggagtgggtctctcttatgtacgttgggagtggggaagaagaacctatatgcagtactctggtagaaggtcattccaccacctcagagacaacatacaagacctcctagtatcngacaagtgacagtcngaccacctgactcgacaccgtcttagtattagttgtaggtaggaacgggtcggttaggttggaggttagaacgtcggacccgtaccgggaacccccgtggtccacgg

SEQ ID NO: 19588 - DNA, 428 bp, Homo sapiens
  misc_feature: GYAE6OF01CK2TF.25.86.H09.1.454.CMB.1.raw
  modified_base (218)..(218): a, c, t, g, unknown or other
  misc_feature (218)..(218): n is a, c, g, or t
  modified_base (426)..(428): a, c, t, g, unknown or other
  misc_feature (426)..(428): n is a, c, g, or t
tcagactgtacagtcacgaccggtgctcgatttagtgctatagacttgggttgggagaagaacctactatgcagactctgtgaagggtcgattcaccacctccagagacaacatcaaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaagggactacggtcatcgtctcctcagccctccaccaagggcccatccggtcttccccctggccgccctgctcccaggacgccacctccgagacgcacaggccggccctggggctgcctggtcaaggactacttccactgtacagtctgagcgggctggcaaggcgcgatagnnn

SEQ ID NO: 19589 - DNA, 566 bp, Homo sapiens
  misc_feature: GYAE6OF01A3M6J.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgattctttgatcgcctccgtagtttaggaaagtggacgtccatacgaaggttcagcggcaggtggatcgtgggacagtatttcgatcctacaccatcagcagcctgacacgcctagaacgtacttcgacgtacctaaccttagttacttacgttaactaaacttaaagtttaacggtacctttaccctcttaccttccggttcgggacggtaacggtaccgaagggtaggaagacgtacgaaacgtacgttggtacggactacgccacgtacg

SEQ ID NO: 19590 - DNA, 542 bp, Homo sapiens
  misc_feature: GYAE6OF01C9W9V.25.86.H09.1.454.CMB.1.raw
  modified_base (279)..(279): a, c, t, g, unknown or other
  misc_feature (279)..(279): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (533)..(533): a, c, t, g, unknown or other
  misc_feature (533)..(533): n is a, c, g, or t
tcagactgtacagtcacgaccggtgctcgatttagtgctatagacttggggtttgggggggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcacatcacttgcgggctagtcgggtcattggcagtgtctttagcctggtatcagcagaaaccgaggggaanctactaagctacctgatctttgatcgcctcgagtttaggaagtggacgtccatcaaggtcagcgacagtcggatcgtagggacagtatttcatccctanaccntacagcacgctcgacagcctagactntacgtgactaacttattatcgtacaaactagtttaacgtacctaccttctccgtccgttacggcggaaggtacccaagggtcggacgtaacacgtaaacgacgtggtcggtactacgacctaccngtcgttccg

SEQ ID NO: 19591 - DNA, 430 bp, Homo sapiens
  misc_feature: GYAE6OF01DZYPG.25.86.H09.1.454.CMB.1.raw
  modified_base (350)..(350): a, c, t, g, unknown or other
  misc_feature (350)..(350): n is a, c, g, or t
  modified_base (421)..(430): a, c, t, g, unknown or other
  misc_feature (421)..(430): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaagggccccatcggtccttccccgtggccgccctgcctccaggagccacctccgagagcacngccggccctgggcctgcctggtcaaggctacttccactgtacagtctgagcgggctggcaaggcgcatagnnnnnnnnnn

SEQ ID NO: 19592 - DNA, 571 bp, Homo sapiens
  misc_feature: GYAE6OF01DZHC2.25.86.H09.1.454.CMB.1.raw
tcagactgtacagtcacgaccggtgctcgatttagtgctatagacttggggtttgggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgtctttagcctggtatcgagcaagaaaccgaggggaagctacctaagctcctgattcttgatgcctctagtttggaaagtcggatcccatcaaggttcagcggctagtggatcgtgggacagtattcactcctcaccatcagcacgctgcagcctagaagtattcgtacgactaacttattacttacgtaactaaactaagtttaacggacctttacccttctacttaccgtcgggacggtaacgggaccgaaaggggttcgaacggtaacgttaacgtaaacggtaacgttggtacggtcgtacgaaccctactagttccgttacg

SEQ ID NO: 19593 - DNA, 559 bp, Homo sapiens
  misc_feature: GYAE6OF01DAFB6.25.86.H09.1.454.CMB.1.raw
  modified_base (282)..(282): a, c, t, g, unknown or other
  misc_feature (282)..(282): n is a, c, g, or t
tcagactgtacagtcacgaccggtgctcgatttagtgctatagacttgggtttgggggcagggagtcagacccactcaggacacagcatggacatgagggtccccgctcagctcctggggcttctgctgctctggctcccaggtgccaaatgtgcccatccagttgacccagtctccatcctccctgtctgcctctgttcgagacatagtcaccatcacttgtcgggctagtcgggtcattggctagtgctttagcctggtatcagcagaaacaggggaacnctcctaagctcctgatctttgatgcctccagtttggaaagtggagtcccatcaaggttcagcggcagtggatcgtgggactagtactttcatccttcaccagtcagcagctgcagcctagaagattctgaccttaacctagttacttgtactaaactaagttttaaggactttaccctgttacccttccgttacgggaccgggtagggacccgtaagggttcgaagtactaaccgaaaacggtacttcgggtacgggcttacggcctaacccgtacg

SEQ ID NO: 19594 - DNA, 593 bp, Homo sapiens
  misc_feature: GYAE6OF01C6LG7.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctacctaagctcctgtatctttgatcgcctctagtttggaaagtcggactccatcgaagttcagcggcagtggatcgtgggacagtacttcgactcctacacatcagcacgtcctgcacgtaccgtagaacgtacttcgtacgtactaaccttatttaacttacggttacctaaacttaacgtttaacggtactttacccgttcttacccttccggtttcgggaccgggtaacgggaacccgtaaagggtaggaacggtaacgtaaccgaaaacggtaacgttacggtacggacgtaccgacgtaccgttacg

SEQ ID NO: 19595 - DNA, 451 bp, Homo sapiens
  misc_feature: GYAE6OF01D4VYY.25.86.H09.1.454.CMB.1.raw
  modified_base (406)..(406): a, c, t, g, unknown or other
  misc_feature (406)..(406): n is a, c, g, or t
  modified_base (436)..(451): a, c, t, g, unknown or other
  misc_feature (436)..(451): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtgggggcaaagggactacggtcatcgtctcctcacgcctccaccaacgggccccagtccggtccttccccgtggccgccctgcctccgaggacgccaccgtccgagacgcacacgccggccctggggctgactggtacaaggcctacttccactgtacngtctgagcgggctgggcaaggcgacatagnnnnnnnnnnnnnnnn

SEQ ID NO: 19596 - DNA, 599 bp, Homo sapiens
  misc_feature: GYAE6OF01DCG3M.25.86.H09.1.454.CMB.1.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagactgtacagtcacgaccggtgctcgatttagtgctatagacttgggtttgggggcaggagtcagacccactcaggacacagcatggacatgagggtccccgctcagctcctgggacttctgctgctctggctcccaggtgccaaatgtgccatccagttgacccagtctccatcctccctgtctgcctctgttcgagacatagtcaccatcacttggtcgggctagtcgggtcattggcagtgctttagcctggtatcagcagaaccaggggaanctcctaagctcctgatctttgatcgcctcagtttggaaagtgagtccatcaaggttcagcgcagtgattcgagggactagtattcatcctcaccatcaagtcaagccgtncagcctagaagtactctacgactaacctatttactagtactaaacgtaatttaaacggacctttaacccctgttcccgttaccgtttaccggggaccgggtaacgggtaaaccccgtaagggtacgggggtaaactaacgttaacccgtaaaaacgggtaaccgttcgggttaacgggtacccgttcggtaacccgaaccgtttaaccgg

SEQ ID NO: 19597 - DNA, 574 bp, Homo sapiens
  misc_feature: GYAE6OF01AIVHO.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtccatctaaggttcaggcgcagtggatcgtgggacagtatttcactcctcaccatcgagcacgcctgcacgtcctagaacgtattcctagtacctaaccttatttacttacgtacctaaacttaaagtttaacggtactttaccccgtcttcccgttcccgttacgggccggaacggggtacccgaagggttgggaacgtactaaccgaaaaccgtacgttagggtacggacctcggcccgtaccgtacg

SEQ ID NO: 19598 - DNA, 600 bp, Homo sapiens
  misc_feature: GYAE6OF01AUUUI.25.86.H09.1.454.CMB.1.raw
  modified_base (400)..(400): a, c, t, g, unknown or other
  misc_feature (400)..(400): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccattctccctgtctgcctctgttcgagacatagtcaccatcacttgtcgggctagtcgggtcagttggcagtgtctttagcctggtatcagcgaagaaaccgaggggaagcctacctaacgctcctgattctttgatcgcctcgtaggtttaggaaagtggacgtcctagtcgtaaggtcaggcggacgaggtggatcgtaggtacagtacttcacttccacaccntcagcagcctcgcacgtcctagaacgtcttcgtacgtactaaccttattattacgtaactaaacgttaacgtttaacggtcctttaaccccgttcttacccgttcccgggttaccggacgggtaaccgggtaaccgtagggtacggagtaacgtaaccgaaaccgttaggtcgtacggtactacggtacctaacgttacg

SEQ ID NO: 19599 - DNA, 509 bp, Homo sapiens
  misc_feature: GYAE6OF01E36LC.25.86.H09.1.454.CMB.1.raw
  modified_base (279)..(279): a, c, t, g, unknown or other
  misc_feature (279)..(279): n is a, c, g, or t
  modified_base (505)..(505): a, c, t, g, unknown or other
  misc_feature (505)..(505): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctacctaagctcctgatctttgatcgcctccagtttggaaagtggagtccatcaaggttcaggcggcaggtggatcgtgggacagtatttcatcctcaccatcagcacgcctgcacgcctagaagtcttctgacctaacctatttacttgtacaactaatttaacgtacttacctctctccgtcggcggaggacgaggtggagatacgaaacgactcgtgactgcnctac

SEQ ID NO: 19600 - DNA, 581 bp, Homo sapiens
  misc_feature: GYAE6OF01CNQ63.25.86.H09.1.454.CMB.1.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacagccggggggtccctgagactctcctgtgtagcctctggattcatgtttgatgattatgccatgcactgggtccgtcgaaggtccggggaagggtctggagtgggtctctcttatgacgttgggatgggagaagaacctactatgcagactctgtgaaggtcgattcaccgacctccagacgacaacatacaaagacctccctagtactctagaccaaagtcggaacagttctagaccaccgtgactacgacctacccgtcctttgttattagtttggttaggtaggtaaagggtcgggttgttaggtagggtagtaagtcgacccggtacgggaaccccccgtgggtaccg

SEQ ID NO: 19601 - DNA, 417 bp, Homo sapiens
  misc_feature: GYAE6OF01AE9LX.25.86.H09.1.454.CMB.1.raw
  modified_base (411)..(417): a, c, t, g, unknown or other
  misc_feature (411)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtcttccccctgcgccctgctccaggagcacctctgggggcacagcggccctgggctgcctggtcaggactacttccactgtacagtctgagcgggctggcaggcgcatagnnnnnnn

SEQ ID NO: 19602 - DNA, 599 bp, Homo sapiens
  misc_feature: GYAE6OF01A2FKY.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaccgaggggaanctctaagctcctgatctttgatcgcctccgtaggtttggaaaggtggacgtccaatcgaaggttcagcggacgaggtggatcggtgggactagtactttcacgtcctacaccatcagtcagcctgcacgaccgtagaacgtatttccgtacgtacctaaccttaatttacttacgttaactaaacgttaaacgtttaaacggttacctttaccccgttcgttacccgttcccgttacggggaccgggaacggggtaaccgtaaggggtaggagtaactaccgaaaacgtacgtaggtacggactacggcctaccgtacg

SEQ ID NO: 19603 - DNA, 416 bp, Homo sapiens
  misc_feature: GYAE6OF01A4JVI.25.86.H09.1.454.CMB.1.raw
  modified_base (414)..(416): a, c, t, g, unknown or other
  misc_feature (414)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgacgacaccgccttgtattattgtgtgaaaggcggtgttgaggtgaatgcctggaacccccgcggtcagcactacttctacatgggcgtctgggggcaaagggactacggtcatcgtctcctcagcctccaccaagggcccatcggtcttccccctggcgccctgctccaggagcacctccgagagcacagcggccctgggctgcctggtcaaggctacttccactgtacagtctgagcgggctggcaaggcgcatagnnn

SEQ ID NO: 19604 - DNA, 566 bp, Homo sapiens
  misc_feature: GYAE6OF01AZB7O.25.86.H09.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(535): a, c, t, g, unknown or other
  misc_feature (529)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (550)..(561): a, c, t, g, unknown or other
  misc_feature (550)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
tcagactgtacagtcacgaccggtgctcgatttagtgctatagacttgggtttgggacgaaaacgaacctaccctacttggcaagaccctctgtgaaggtcgattccaccaccctccagagacgaaccagtcaagaactccccttgtagtcgtgcaaatggacaagtcgtgaccacctgatggacaccgccttgtattatgtgtgaaaggcgtgtgagtgaatgccgtcgaccccgnggtcagcactactcacgntggcgtctgggtcaaaggacttacggtctaatcgtacgtccgtcgacgccctccgacccgaagggaccccaagtccggtccttcccccgtggccgcccgtgccgtccgaggtacgccgacccgtccgtaagacgaccaaccgacgccggacccgtggcctcgcccgtaggtaccgtaacggacctacgttaccgacgtcgtaccgacgttcccgtaggacgccgggtctacgggacccaaaggccgacgaagtagccngagcgngngngngngnnnnnnngngngnntgngnngnnnnnnnnnnnngngng

SEQ ID NO: 19605 - DNA, 554 bp, Homo sapiens
  misc_feature: GYAE6OF01AGA4Y.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaanctcctaagctcctgatctttgatgcctccagtttggaaagtggagtccatcaaggttcagcggcagtggatctgggacagtatttcatcctcaccatcagcagcctgcagcctagagtattctgctaaccttattattacgtacctaaacgtaagtttaaacggtactttacccctcttccttacccgttcgggaccgggtaagggtacccgtaaggggtgggaagtacgttaccgaaaacgtacgtaggtacgggacctcggtaccaccgttacg

SEQ ID NO: 19606 - DNA, 419 bp, Homo sapiens
  misc_feature: GYAE6OF01A5VU5.25.86.H09.1.454.CMB.1.raw
  modified_base (416)..(419): a, c, t, g, unknown or other
  misc_feature (416)..(419): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatgaacagtctgagagctgaggacacggccttgtattactgtgcaaaaattaattacgttagcagcagctcggaaagggttccttactactactactactacatggacgtctggggcaaagggccacggtcaccgtctcctcagcctccaccaagggcccatcggtcttcccccctggcaccctcctccaagagcacctctgggggcacagcggccctgggctgcctggtcaaggctacttccactgtacagtctgagcgggctggcaaggcgcatagnnnn

SEQ ID NO: 19607 - DNA, 422 bp, Homo sapiens
  misc_feature: GYAE6OF01DC729.25.86.H09.1.454.CMB.1.raw
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
  modified_base (415)..(422): a, c, t, g, unknown or other
  misc_feature (415)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctcaccaaggcccatcggtctcccctggcnccctgctccaggagcacctccgagagcacagcggccctggggcctgccctggtcaaggctactccatgtacngtctgagcgggctgggcaagggcncacgtagnnnnnnnn

SEQ ID NO: 19608 - DNA, 564 bp, Homo sapiens
  misc_feature: GYAE6OF01DFFJ1.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaagctacctaagctcctgatctttgatgcctcagtttggaaagtggagtccatacaaggttcagcggcaggtgatcgtggacagtacttcactcctacaccatcagcagcctgcagcctagaagtacttctacgacctaacctttattacttacgtaactaaacttaagtttaacggtacctttaacccttcttccttcccggtttacgggaccgggtaacgggacccgtaaagggtaggaaggaacttaacgaaacgtacgtggtacggctacggccacgttacg

SEQ ID NO: 19609 - DNA, 425 bp, Homo sapiens
  misc_feature: GYAE6OF01BVOYR.25.86.H09.1.454.CMB.1.raw
  modified_base (217)..(217): a, c, t, g, unknown or other
  misc_feature (217)..(217): n is a, c, g, or t
  modified_base (416)..(425): a, c, t, g, unknown or other
  misc_feature (416)..(425): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggccccatcggtcttccccctggcgccctgctccaggagcacctccgagagcacagcggccctgggctgcctggtcaaggactacttccactgtacagtctgagcgggctgggcaaggcgcatagnnnnnnnnnn

SEQ ID NO: 19610 - DNA, 428 bp, Homo sapiens
  misc_feature: GYAE6OF01D1SN1.25.86.H09.1.454.CMB.1.raw
  modified_base (218)..(218): a, c, t, g, unknown or other
  misc_feature (218)..(218): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (421)..(428): a, c, t, g, unknown or other
  misc_feature (421)..(428): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggactacggtcatcgtctcctcagcctccaccaagggccccatcggtccttcccctggccgccctgctccaggagccacctccgagagcacagccggccctggggctgcctggtcaaggctacttccactgtacngtctgagcgggctgggcaagggcncagtagnnnnnnnn

SEQ ID NO: 19611 - DNA, 565 bp, Homo sapiens
  misc_feature: GYAE6OF01BYA01.25.86.H09.1.454.CMB.1.raw
  modified_base (276)..(276): a, c, t, g, unknown or other
  misc_feature (276)..(276): n is a, c, g, or t
  modified_base (394)..(394): a, c, t, g, unknown or other
  misc_feature (394)..(394): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagttggaaagtgactccatcaaggtcagcggcaggtggatcgtgggacagatttcattcctcacatcagcagcctgcacgcctagaagtnttctgacctaaccttattattgtactaaactaagtttaaagactttaaccctcttaccgttccgttaccgggacggtaaggggaaccctaaggggttcggaagtaacgttaaccgaaaaacggtaacgttcggtacgggtacctacggacctaaccctagttcccgttacg

SEQ ID NO: 19612 - DNA, 424 bp, Homo sapiens
  misc_feature: GYAE6OF01CHZNZ.25.86.H09.1.454.CMB.1.raw
  modified_base (218)..(218): a, c, t, g, unknown or other
  misc_feature (218)..(218): n is a, c, g, or t
  modified_base (414)..(424): a, c, t, g, unknown or other
  misc_feature (414)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaagggactacggtcatcgtctcctcagcctccaccaagggcccatcggtcttcccctggccgccctgctccaggacgcacctccgagagcacagcggccctgggctgcctggtcaaggctactccactgtacagtctgagcgggctggcaaggcgcatagnnnnnnnnnnn

SEQ ID NO: 19613 - DNA, 579 bp, Homo sapiens
  misc_feature: GYAE6OF01BONBT.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatctttgatgcctcagttgaagtggatccatcaagttcagcggcagtgatcgtggacagatttcactcctcaccatcagcagcctgccagcctagaagtacttcacgacctaaccttatttacttacggtactaaactaattttaacggtactttaccctcttaccttcccggtttacgggaccgggtaacggggtaacccgtaaggggttaggaacggtaacgttaacccgaaaacggtaacgttacgggtacggtaccgtacggtacccgtaaccgttacccg

SEQ ID NO: 19614 - DNA, 699 bp, Homo sapiens
  misc_feature: GYAE6OF01B8J7W.25.86.H09.1.454.CMB.1.raw
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaagtgtgccatccagttcgacccagtcctccactccttccctgtctgcctctcgttcgagacatacgtccaccatctacttggtccgggtctaggtcgggtcagttggctagtcgtactttagccgttggtactcgagaccaaggaaaccggaggggaactctaccgtaaggccttaccgtgtacttcgtttagactcgccctacgtaggtttaggaaagtcggactccaagtccgtaagggttccagggtccgtgtacggtggactcggtagggaactagttactttcacgtaccctacactatcaggtcctaacggtcctacggctacgtacgttaggaacttaccttcaacgtaaccctttaaacgtttatttaaccgtttacgggtaaccctaaaaggttttaaaccggttttaacggacccttttacccgacgttcccggtttaccgtaacggggtccggggtaacgggtaaaccgtaagggttacggaacgtaccttaaacggaaaccgtacgttcgggacggttaccacgttacaccgttaacg

SEQ ID NO: 19615 - DNA, 706 bp, Homo sapiens
  misc_feature: GYAE6OF01BAXF6.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcgggctagtcgggtcattggcagtgctttagcctggtatcagcaagaaaccgaggggaagcctacctaagcctccgtgtacttctttgatcgtcctaccgtagtttaggaaagtggaacgtcccaatcgaaggttcagcggcaggtgatcgtaggactagtatttcgacttccctacaacctataccgacgtcgaacggtccctaggaccgtaacggtcccttaagggtaaacgttacgtttaccgtaacggtacccttaaacctttaacgttttaacgtttacggttaaaccttaaaacgtttaaacgtttttaacgggtaacccttttaaccccttacctttacccgttacccgttaccggggtaccggggtaaacggggtaaccccgtaaaggggttacgggaacgttaacgtaaaccggtaaaaccggtaacggttacgggtaccggtcgtaccggaacctaacccgttagttccgttacccg

SEQ ID NO: 19616 - DNA, 537 bp, Homo sapiens
  misc_feature: GYAE6OF01A19IZ.25.86.H09.1.454.CMB.1.raw
  modified_base (279)..(279): a, c, t, g, unknown or other
  misc_feature (279)..(279): n is a, c, g, or t
  modified_base (407)..(407): a, c, t, g, unknown or other
  misc_feature (407)..(407): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatcgcctccagtttggaagtggagtccatcgaaggttcgagcggcaggtggagtcgtagggacaggtactttcactcctcacctatcacgcagcctgcagcctgaanttctgacaacttattattgtacaacgtattaacggactttacctctctcgtcgggcggtaagggacccgtaagggttggaagtactaccgaaaacggtaaccgttggtacggtacctcgcctaccgtacg

SEQ ID NO: 19617 - DNA, 441 bp, Homo sapiens
  misc_feature: GYAE6OF01BS2OD.25.86.H09.1.454.CMB.1.raw
  modified_base (337)..(337): a, c, t, g, unknown or other
  misc_feature (337)..(337): n is a, c, g, or t
  modified_base (431)..(441): a, c, t, g, unknown or other
  misc_feature (431)..(441): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccctgcggtcagcactactctacagtgggcgtctggggacaaagggactacggtcatcgtctcctcagcctccaccaagggccccagtccggtccttccccctggccgccctgcctccgaggacnccacctccgagagcaacagccggcctgggctcgcctggtacaacggactacttccactgacagtcgtgagcgggctggcgaacggcgcagtagnnnnnnnnnnn

SEQ ID NO: 19618 - DNA, 589 bp, Homo sapiens
  misc_feature: GYAE6OF01D64WB.25.86.H09.1.454.CMB.1.raw
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttggtcggctaggtcgggtcagttggctagtgtctttagcctggtatcagcaagaacgaggganctactagctcctgatcttgatcgcctctagttaggaagtggacncctatacgaaggttcagcgcaggtgactcgtaggacagtatttcagtccctacgtaccagttaccagcacgcctgacacgtcgtagaatcttccagtacctaaacgttattcgtttagtaaccctaaagttaacttttaacggtacctttaccccttcgttacccgtttccggtaccgggtaccgggaacgggtaaccgtaaggggtaggtaacgtaccgtaaacgtaaacgtaacgtggttaccggactaccgacgtactaccg

SEQ ID NO: 19619 - DNA, 413 bp, Homo sapiens
  misc_feature: GYAE6OF01B6APG.25.86.H09.1.454.CMB.1.raw
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgtgcgtctggggcaaagggactacggtcatcgtctcctcagcctccaccaaggcccatccggtcttccccctggccgccctgcctccaggacgccacctccgagacgcacagcggccctgggctgcctggtcaagctactccactgtacagtctgagcggctggacaggcnatgn

SEQ ID NO: 19620 - DNA, 505 bp, Homo sapiens
  misc_feature: GYAE6OF01EPE2D.25.86.H09.1.454.CMB.1.raw
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagactgtacagtcacgaccggtgctcgattttagtgctatagacttggggtttggggagaagaacctactagtgcagactctgtgaaggtcgagttccaccacctcagagacgaacatcaagaactccctgtatctgcaaactggacagtctgactacctgatgaccaccgccttgtattattgtgtgaaggcggtgttgaggtgaatgcctcggaaccccgcggtcagcgactacttctacatgggctctggggtacaagggactacggtacatcgtcctccgtcacgcctccaccaagggccccatcggtcttccccgtggccgccctgctccaggngccactcgagncangcgctggctgctggtcaggctactcatntacngtctgagcgggtntggacaaggtcgacagttacgntgngtcanacgtacatntacgagtgactagatacagtaactcgnctntncgtctntcgtcgtctcgtcgtctcgcnctgtgtc

SEQ ID NO: 19621 - DNA, 595 bp, Homo sapiens
  misc_feature: GYAE6OF01CAO0K.25.86.H09.1.454.CMB.1.raw
  modified_base (584)..(584): a, c, t, g, unknown or other
  misc_feature (584)..(584): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgttgcctattttaaaaggtgtccagtgtgaagtgcaactggtggagtcgtggggggagccggtggtacgagggcccgggggggtccctggagactctcctgtgtagcctctggattcattgttttgatgattatgccatgcacgtgggtccgtcgaacgggtccggggaagggtctgggagttgggtctctctttatggtacgttgggatagggggagaaacggtaaaccctagtatggcagtacctcgtgtaggaaggtcaattccaccacctcagacgacaacatacaacgacctccctagtactctgacaagtcgacacgttcacgaccaccgtgatcgacctaccgtcttgtattagttgtaggttaggaacgggtggttaggttgggacggttagacgttcgacccgtaccgggacccccgngggtcccgacg

SEQ ID NO: 19622 - DNA, 434 bp, Homo sapiens
  misc_feature: GYAE6OF01B39UM.25.86.H09.1.454.CMB.1.raw
  modified_base (416)..(416): a, c, t, g, unknown or other
  misc_feature (416)..(416): n is a, c, g, or t
  modified_base (422)..(434): a, c, t, g, unknown or other
  misc_feature (422)..(434): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtggggcaaagggactacggtcatcgtctcctcagcctccaccaagggccccatccggtcttccccctggccgccctgcctccaggagcacctccgagacgcacagccggccctggggctgcctggtcaaggctacttccactgtacagtctgacgcgggctgggcaaggcncatagnnnnnnnnnnnnn

SEQ ID NO: 19623 - DNA, 439 bp, Homo sapiens
  misc_feature: GYAE6OF01DBZ35.25.86.H09.1.454.CMB.1.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (421)..(439): a, c, t, g, unknown or other
  misc_feature (421)..(439): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattatgtgtgaaaggcggtgttgaggtgaatgcctggaacccccgcggtcagcactacttctacatgggcgtctgggggcaaagggctacggtcatcgtctcctcagcctccaccaagggccccatccggtccttccccctggccgccctgcctccgagggagccacctccgagacgcacagccggccctgggctgcctggcaaggctactccatgacngtcngagcggctgggcaaggcgacagtacgnnnnnnnnnnnnnnnnnnn

SEQ ID NO: 19624 - DNA, 594 bp, Homo sapiens
  misc_feature: GYAE6OF01C54T1.25.86.H09.1.454.CMB.1.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaanctacctaagctcctgattctttgatcgcctccgtaggtttggaaaggtggacgtcccagtcgaaggttcacggcggcaggtggtacgtcgtagggacagtactttcactcctacacctatcagcacgcctgcagcctagaacgtcttctcgacctaacgtttattagttactaactaacttaatttaacggtaacctttacccgttccttacccgttcccggttcggggaccgggtacgggaacccggtaaagggtacggaacggtaactaccgaaaacgtacgttagggtacggccgtacgccgtacgtacg

SEQ ID NO: 19625 - DNA, 448 bp, Homo sapiens
  misc_feature: GYAE6OF01C3FOU.25.86.H09.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (413)..(413): a, c, t, g, unknown or other
  misc_feature (413)..(413): n is a, c, g, or t
  modified_base (420)..(448): a, c, t, g, unknown or other
  misc_feature (420)..(448): n is a, c, g, or t
tcagactgtacagtcacgaccggtgctcgatttagtgctatagacttgggttgggagaagaacctactatgcagactctgtgaagggtccgattcaccacctccagagacaacatcaagaactccctgtatctgcaagtggacagtctgacacctgatgacaccgccttgtattattgtgtgaaaggcggtgttgaggtgaatgccnggaaccccgnggtcagcactactctacatggcgtctgggggcaaaaggactaacggtcagtcgtctcctcacgccncaccaaaggccaatcggtcttcccctggccnccncgctccaggancactccgagacncgaacncgcggcccgtggggctgccctgggtcaaggacctacttcactgacagctgagcggctggacaaggcncgatagnnnnnnnnnnnnnnnnnnnnnnnnnnnnn

SEQ ID NO: 19626 - DNA, 537 bp, Homo sapiens
  misc_feature: GYAE6OF01BUCZ1.25.86.H09.1.454.CMB.1.raw
  modified_base (530)..(530): a, c, t, g, unknown or other
  misc_feature (530)..(530): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatctttgatgcctctagtttggaagtggacgtccatcgaaggttcgagcggcagtggatcgtgggacagtattcactcctcaccatcagcacgcctgcacgcctagaagtattctgcctaaccttattattgtacaacttaagtttaaacggtactttacccttcttcctaccgttcggacgggacgggaccgtaagggtaggacgtatacgaaacgacgttggacgtctacgacaccngttctcg

SEQ ID NO: 19627 - DNA, 793 bp, Homo sapiens
  misc_feature: GYAE6OF01DA29L.25.86.H09.1.454.CMB.1.raw
  modified_base (284)..(284): a, c, t, g, unknown or other
  misc_feature (284)..(284): n is a, c, g, or t
tcagactgtacagtcacgaccggtgctcgatttagtgctatagacttgggtttggggggcaggagtcagacccactcaggacacagcatggacatgagggtccccgctcagctcctgggggcttctgctgctctggctcccaggtgccaaatgtgccatccagttgacccagtctcatcctcctgtctgcctctgttcgagacatacgtcacatcacttggtcggcttaggtcgggtcagttggcagtgtctttagcctggtatcagcaagaaaccgagggganctacctaagctcctgtacttcgtttagacttcgtcccttaccgtagggttttacggaaaaggttcgggtacgttccccgtaagttaccggtaaacgggtttccgaacgggtccgggaccgtaaagggttcggggtaacgtttccgggttacgggggtaacctaaacggggttaacttttttacccgaacctttacccccgttaaccgtaaccctaaccgttaccgaacggttaccccgaaccgggtacccctttacgggaccgtaccggtaaccccggttaggtaaaaccggttacttttcccggttaacggtaacccttaaacccgttttaattttaacgtttacggtaaacccttaaaacgttaaagttttaaaccggtaacttttaacccccttcgttacccgttacccggtttcggggacccgggttaacgggaccgtaaaggggtcggtaagtaacgtaaccgaaacgtacggtacggtacggtacctcggacccgtaacttcg

SEQ ID NO: 19628 - DNA, 596 bp, Homo sapiens
  misc_feature: GYAE6OF01B44SB.25.86.H09.1.454.CMB.1.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaanctcctaagctctgatctttgatncctcagtttggaaagtggacgtccatcgaaggttcaggcggcagtggactcgtgggacagtatttcgactcctcaccatcagcagcctgccacgcctagaagtacttctacgactaaaccgttatttaacgtttagtaacctaaaccgttaaagttttaaacggtactttaaccccgttctacccttacccggttacgggaccgggtaacgggaacccggtaagggttacggaacggtaactaaccgaaaaacggtaaccgttcggtacgggtacttgaccgtaacccttacg

SEQ ID NO: 19629 - DNA, 416 bp, Homo sapiens
  misc_feature: GYAE6OF01EAHLN.25.86.H09.1.454.CMB.1.raw
  modified_base (329)..(329): a, c, t, g, unknown or other
  misc_feature (329)..(329): n is a, c, g, or t
  modified_base (406)..(406): a, c, t, g, unknown or other
  misc_feature (406)..(406): n is a, c, g, or t
  modified_base (411)..(416): a, c, t, g, unknown or other
  misc_feature (411)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatcagtccttcccctggcgccctgctccaggancacctccgagagcacagcggccctgggctgcctggccaaggctacttccatgtacagtctgagcggctggcaaggcncatgnnnnnn

SEQ ID NO: 19630 - DNA, 498 bp, Homo sapiens
  misc_feature: GYAE6OF01CUDSU.25.86.H09.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (483)..(498): a, c, t, g, unknown or other
  misc_feature (483)..(498): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgcttgtattattgtgtgaaggcggtgttgaggtgaatgcctcggaaccccgnggtcagcactacttcacagtggcgtcgtggggacaaagggctacggtcatcgtctcctcacgcctccaccaagggcccctacgtccggtccttcccccgtggccncccttgacctcccgaggacgccaaccgtcgagacgcgaacgacggtccggcccgtgggccctaggtccccgttgggtaccaaacgggtaccttaccttaccgacgttacgtaccagttccgtaggacgggtccgggcgtgggacgaaccgggcacgtatagnnnnnnnnnnnnnnnn

SEQ ID NO: 19631 - DNA, 580 bp, Homo sapiens
  misc_feature: GYAE6OF01DQNFP.25.86.H09.1.454.CMB.1.raw
  modified_base (416)..(416): a, c, t, g, unknown or other
  misc_feature (416)..(416): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctggggggagccgtggtacaggccgggggggtccctgagactctcctgtgtagcctctggattcatgtttgatgattatgccatgcacgtgggtccgtcgaagggtccggggaagggtctggagtgggtctctcttatgacgttgggatgggagaagaacctatatgcagactctgtgaaggtcgattcaccacctccagagacaacatacaanaactccctagtatctagacaatggacagtctagacacctgatcgactaccgtcttagtattagttgttaggtaggtaaacgggtcgggttaggtttggtaagggttaggtaaacgttcgggacccgttaccgggaaacccccccggtcgggtacccgtaaccgg

SEQ ID NO: 19632 - DNA, 689 bp, Homo sapiens
  misc_feature: GYAE6OF01D2FHK.25.86.H09.1.454.CMB.1.raw
tcagactgtacagtcacgaccggtgctcgatttagtgctatagacttggggtttgggagaagaacctactatgcagactctgtgaagggtcgattcaccaccctccagagacaacatcgaagaactccctgtatctgcgaaactggacagtctgacgacctgatgacaccgccttgtattattgtgtgaaggcggtcgttgaggtgaatgccgtcggaaccccgcgtcacgcactacgttctacatgggcgtcgtggggtcaaaggactacggtcaatcgtctcctcacgtcctaccaccgaacggccccaatccgggttccttcccccgtcggccggcccgtcgtccttaccgacggtacgtaccctaacccgtcccggaacggtacggcccaaacgcggtccggtcccgtcggggcctcggtcccgttagggtaccgaaacggggtaccttaccgttaccctaaccgtttacggtaaacctaacggttacgttaacggacggggtacccgggggtaccggttaccgggggacgtaaaccggggaccggtacgtaaacgggtaacggtaggtgttaccggactcggcgtacgtagatacgacgacgtacgtcgtacgtacgtcgtacgtcgacgacgacgtacgacgacgtagcgtacgacgacgacgtcgacgacgacgtcgtgtcg

SEQ ID NO: 19633 - DNA, 437 bp, Homo sapiens
  misc_feature: GYAE6OF01B7CQL.25.86.H09.1.454.CMB.1.raw
  modified_base (217)..(217): a, c, t, g, unknown or other
  misc_feature (217)..(217): n is a, c, g, or t
  modified_base (421)..(421): a, c, t, g, unknown or other
  misc_feature (421)..(421): n is a, c, g, or t
  modified_base (427)..(437): a, c, t, g, unknown or other
  misc_feature (427)..(437): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttcacatgggcgtctggggcaaagggctacggtcatcgtctcctcagcctccaccaagggccccatccggtccttcccccgtggccgcccctgcctccaggacgccacctccgagacgccacacggccggccctggggcctgcctggtcaaggccttactccactgtacagtctgagcgggctggcaaggcncatagnnnnnnnnnnn

SEQ ID NO: 19634 - DNA, 467 bp, Homo sapiens
  misc_feature: GYAE6OF01EQELK.25.86.H09.1.454.CMB.1.raw
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
  modified_base (439)..(467): a, c, t, g, unknown or other
  misc_feature (439)..(467): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtgggggcaaaagggctacggtcatcgtctcctcagcctccaccaagggccccatcggtccttccccctggccnccctgcctccaggnccaccctccgagagcacgacgccggcccgtgggctgcctcggacaaggacctacttccactgtacagtcnggtacggcgggctgggacaacggcgcaagtagnagtnnnnnnnnnnnnnnnnnnnnnnnnnnnnn

SEQ ID NO: 19635 - DNA, 564 bp, Homo sapiens
  misc_feature: GYAE6OF01D12TB.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatcttgatgcctctagtttaggaaagtggacgtccatacgaaggttcaggcggcaggtggatcgtagggactagtatttcactcctcaccatcacgcacgccctgaccgagtcctagtaagtcttcgtacgaccttaaccttatttacttagtaactaattaacgtttaacgtacctttacccttcttccgttccgtcgggaccggtaaggtacccgtaaggtggaacgtactacgaaacgtacgtggtcggctacgacctactcgtcttcg

SEQ ID NO: 19636 - DNA, 617 bp, Homo sapiens
  misc_feature: GYAE6OF01B5TD1.25.86.H09.1.454.CMB.1.raw
  modified_base (283)..(283): a, c, t, g, unknown or other
  misc_feature (283)..(283): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcgggctaggtcgggtcattggcagtgctttagcctggtatcagcaagaaccgaggggaanctacctaagctcctgattcttgatcgcctcgtagtttacggaaagtggactcccagtccgtaaggttcaggcggacaggtggatcgtgggatagtattcatcctcacatcagcacgcctgactacgaccttagaacgtacttcgtacgaccttaaacctttatttaactttacgtaacctaaaacgtttaacgtttaacggtaccttttaacccctcgttaccttaccccggtacgggaccgggtaaccggggtaaccgtaaaggggtccggaaaggtactaaccggaaaaggtaaccttcgggtacgtaccgtacggtacctaacccgttacg

SEQ ID NO: 19637 - DNA, 708 bp, Homo sapiens
  misc_feature: GYAE6OF01EM462.25.86.H09.1.454.CMB.1.raw
  modified_base (617)..(617): a, c, t, g, unknown or other
  misc_feature (617)..(617): n is a, c, g, or t
tcagactgtacagtcacgaccggtgctcgattttagtgctatagacttgggtttgggagaagaaccctactatgcaagacgtcgtgttcgaaggttcgattcaccacctccagagacaacatcaagaactccctgtagtcttggcaaatggactaggttcctgtacaccttgtaatgacaccgctttgtattaattgtgtagtaaggcggtgttggaggggtgaagttcgaccgttcggaaccccggcggttccaggcaccttacttctacgagtcgggcgttcgtggggacaaagggtcctaacggtcaacttcgtctcctcgacgcctcgaccgacggccctactccggtaccgttcccccgtaggggccgtcccgtggtccgtccgacggacgtccgttaaccgttccgaagtacgcgaacgtacggtcccggtacccgtagggtaccttacgacccgttacgggtaaccgtaaacgggtaccgtttaacccggtttacccgaacgtttaccgttaacctacgtttacccgttacggtaacgggaccggggtaccttacgggtaccccgaaaagggtacccgaaccgtaaagtttacgacttcacgatagcganacgacgtacgagtacgagacgacgtcgtagttacgtacgtacgtagtagaggtacgcgtgcgcgacgtacacgtactactatcgtgtgtcg

SEQ ID NO: 19638 - DNA, 644 bp, Homo sapiens
  misc_feature: GYAE6OF01CE1E8.25.86.H09.1.454.CMB.1.raw
tcagactgtacagtcacgaccggtgctcgatttagtgctatagacttgggtttgggggggagtcagacccactcaggacacagcatggacatgagggtccccgctcagctcctggggcttctgctgctctggctcccaggtgccaaatgtgccatccagttgacctagtctccatcctcctgtctgcctctgttcgagacatagtcaccatcacttggtcgggctaggtcgggtcagttggcagtgctttagcctggtatcagacagaaaccgaggggagctacgtaagctcctgtattctttgatcgtcctcctaggtttaggaaagtcggacgttccataccgtaaggttcaggtcggctaggtggatcgtagggactagtactttacacttccctacaccgatcacggacacggccctaggcaacggtcctagaagtactttcgacgtaccctaacttatttaagttacgtaactaaaacgttaaattttaaacgggtaccttttacccctctttacccgttacccggttacgggtaacgggtaccggggtaacccgtaaggggttggtaaaccgtaacgtaaacccgtaaacggtaaccttggggacgtccttacggaccctaacgttgttcctttaccg

SEQ ID NO: 19639 - DNA, 594 bp, Homo sapiens
  misc_feature: GYAE6OF01BTEQU.25.86.H09.1.454.CMB.1.raw
  modified_base (275)..(275): a, c, t, g, unknown or other
  misc_feature (275)..(275): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtcccatcaaggttcagcggcaggtgatcgtgggacagtatttcattcctcacatccagccagcctgcagcctagaacgtattctgacctaacctttatttacgttacgttaccaaacgttaacgttttaaacgggtaacttttaccccttcgttaccctttccccgttaccggggtaccgggaacgggtaacccgtaaggggtacgggaacgtaagtaccgtaaaacgtacgttcggtacggtacctacggtacctaaccgtgttccgttaccgg

SEQ ID NO: 19640 - DNA, 652 bp, Homo sapiens
  misc_feature: GYAE6OF01CULRK.25.86.H09.1.454.CMB.1.raw
  modified_base (159)..(159): a, c, t, g, unknown or other
  misc_feature (159)..(159): n is a, c, g, or t
  modified_base (632)..(652): a, c, t, g, unknown or other
  misc_feature (632)..(652): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacaccttagngtacaccgcctcgttattaattgttggttgaaagggaacggggttggttggtaggtaggtaagtacgtccgtccggaacccccggaccccgggtcgtacgcacctacttccttacacgtgggtcgggtccgtggggcggaaacgggaacggtaccggtaccgtaactcggttccttcccttacctacgaccgtcccctaaccccgaacggggaccccgacctccgggttccccggtttcccccccttccgggtccggcccccgtccggtaccgtcccgacgggaacggaccgaccccttaccccggaccggaacgccaaccgaccggtcccgggccccggtccggggcggtccgccgtcggttacgaaacggtaacccgttactttaccctaccgttacgtaccggtaacgtcggttagaccgggggccggggttccgtaggtccggaaaacggccgggtacaacgttaggcnnnnnnnnnnnnnnnnnnnnn

SEQ ID NO: 19641 - DNA, 628 bp, Homo sapiens
  misc_feature: GYAE6OF01DGBZ3.25.86.H09.1.454.CMB.1.raw
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcgggctagtcgggtcagttggcagtcgtctttagccgtggtatcagcaagaaaccgaggggaactcctacgtaagctcctggtattctttgactcgcctacgtagtttaggaagtggactccatacgaaggtcaggtcgacgtaggtggtactcgtaggggactaggttactttcactcctacacctatacgacgcacgtccctagacacgtcctaggaagtacttctacgtacctaaacgttattaagtacgtactaaacttaagttttaaccggtacttaccccttcgttaccgttacccggtaccggggacggtaacgggtaccgaaggggttacggaacgtaagtaaacccgaaacggtacgtttagggcggtacgttacggaccctaacgttacgtcgtttaccg

SEQ ID NO: 19642 - DNA, 682 bp, Homo sapiens
  misc_feature: GYAE6OF01BIMKR.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaagctcctaagctcctgatctttgatcgctcagtttgaagtgatccatcaaggttcagcggctagtggatcgtagggacaggtactttcgacttccctacacctaatcgaacgcctaacgcccgttagacccaggtaccccgtaggtaaaacggtctttccgtacggtacctaaaaccccgtttagttttaaccttacgggttaaacctaaaaccgtttaaaagtttttaaaccggaacctttttaaccccctaccgtttaccccttaccccggtttaccggggacccggggtaaccggggtaaacccgggtaaagggttagggaaaccgttacgttaaacccggtaaaaacgggtacccgttcgggtacgggtacccttaacggacccgtaaccccgttaaaccgg

SEQ ID NO: 19643 - DNA, 545 bp, Homo sapiens
  misc_feature: GYAE6OF01B4S4V.25.86.H09.1.454.CMB.1.raw
  modified_base (277)..(277): a, c, t, g, unknown or other
  misc_feature (277)..(277): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagcagaaaccaggggaanctacctaagctcctgatctttgatcgcctcctagtttggaaagtggacgtcccatcaaggttcagcggcagtggatcgtgggactagtatttacatcctcaccatcagcagccctggcagcctagaagtnttcngacctaactnttatagtacaaataatttaagactttacctctacgtcccgtcgggacggacggaccgtaaggtcggaacgtagtacaaaccggtacgtggtacgggcttacggacccacctagttcccgttacg

SEQ ID NO: 19644 - DNA, 589 bp, Homo sapiens
  misc_feature: GYAE6OF01CSVKH.25.86.H09.1.454.CMB.1.raw
  modified_base (281)..(281): a, c, t, g, unknown or other
  misc_feature (281)..(281): n is a, c, g, or t
  modified_base (387)..(387): a, c, t, g, unknown or other
  misc_feature (387)..(387): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagccttggtatcagcaagaaaccgaggggaanctcctaagctcctgatctttgatcgcctccgtagtttggaaagtggacgtcccatacaagggttcaggcggcaggtggatcgtgggacagtatttcatcctcaccntcagcagcctgcacgcctagaagtcttccagactaaccttatttattagtacctaaacttaagttttaacggaacttttacccgtcttaccgttccggttaccgggaccgggtaacgggtacccgtaaggggttacggaagtaaccgtaaccgtaaaacggtacgttacgggtacggtaccttacggacctaacccgttacg

SEQ ID NO: 19645 - DNA, 424 bp, Homo sapiens
  misc_feature: GYAE6OF01BUU3A.25.86.H09.1.454.CMB.1.raw
  modified_base (332)..(332): a, c, t, g, unknown or other
  misc_feature (332)..(332): n is a, c, g, or t
  modified_base (414)..(414): a, c, t, g, unknown or other
  misc_feature (414)..(414): n is a, c, g, or t
  modified_base (419)..(424): a, c, t, g, unknown or other
  misc_feature (419)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaagggccccatcggtccttccccctggccgccctgcctccaggngcaccctcgagagcacagcggccctgggctgcctggtcaaggctacttccactgtacagtctgagcgggctgggcaaggcanatagnnnnnn

SEQ ID NO: 19646 - DNA, 438 bp, Homo sapiens
  misc_feature: GYAE6OF01AK5UR.25.86.H09.1.454.CMB.1.raw
  modified_base (311)..(311): a, c, t, g, unknown or other
  misc_feature (311)..(311): n is a, c, g, or t
  modified_base (427)..(438): a, c, t, g, unknown or other
  misc_feature (427)..(438): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaacgggcccatcggtcttcccccnggccgccctgctccaggagcacctccgagacgcacagccggccctggggctcggccctggtccaaggacctaccttccactgtacagtctgaggcgggctggcaaggcgcagtagnnnnnnnnnnnn

SEQ ID NO: 19647 - DNA, 472 bp, Homo sapiens
  misc_feature: GYAE6OF01AKIA0.25.86.H09.1.454.CMB.1.raw
  modified_base (217)..(217): a, c, t, g, unknown or other
  misc_feature (217)..(217): n is a, c, g, or t
  modified_base (353)..(353): a, c, t, g, unknown or other
  misc_feature (353)..(353): n is a, c, g, or t
  modified_base (460)..(472): a, c, t, g, unknown or other
  misc_feature (460)..(472): n is a, c, g, or t
tcagactgtacagtcacgaccggtgctcgatttagtgctatagacttgggttggggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgnggtcagcactacttcacagtgggcgtcgtggggacaaagggtctacggtcagtccgtctcctcacgccctccaccgaagggccccagtcccggtaccttccccccgtggcccgtccccgtgccctccgagggaccnccaccctccggagacgccacgacggccggccctgggcctcgcccgtggcaaggtcctacttccactgtacagtctgacgcgggctgggacaagggccgacagtagcnnnnnnnnnnnnn

SEQ ID NO: 19648 - DNA, 644 bp, Homo sapiens
  misc_feature: GYAE6OF01A8SK2.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctccaggtgccaaatgtgccatccagttgacccagtctccatcctccctgtctcgcctctgttcgagacatagtcaccatcacttggtcgggctaggtcgggtcagttggctagtgtctttagccgtggtatcagcaacgaaaccggaggggacgtcctacctaacgcctcctggtattcgtttagactcggtcccttaccgtaggtttacggtaaaggtcggtacgtaccagtacgtaacggttcgaggcggcgtaggtgtagtcgtagggtacagtacttctactcctacacactacgacgtcacgcgcgactacggccgtagtacgtactttaccgacgtaaccttaaccttagtttacgttacgttaaccctaaagttaactttaacggttaccctttaacccgttccgttacgttccggtaccggggacggtaacgggtaacccgtagggtacggtacgtaacgtaacgtaaacgtacgttacggtacgactcgaccgtcttacg

SEQ ID NO: 19649 - DNA, 652 bp, Homo sapiens
  misc_feature: GYAE6OF01AIUEY.25.86.H09.1.454.CMB.1.raw
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccgtggtacaggccggggggtccctgagactctcctgtgtagcctctggattcattgtttgattgattatgccatgcacgtgggtccgtcgaacgggtccggggaaggtcgtggaggtcgggtctcgtcttagtgtacgtttgggagttaggggaagaaacggaacctactagtgacgagactcgtgtaggtaacgggtctacttacaccctacctccaagagaacaacactaacgaacgtacctacccgtgtactacgtcgaacaaacgtggtaacaggttacctacgaacctaccgtagtaactacgtaaccctacccggtcctttaagttatttagtttggtaggttacgggaaacgggttcgggttagttagggacgggttagaacggttccggtacccgttacccgggaacccccgggttcggtcgtaacccgg

SEQ ID NO: 19650 - DNA, 474 bp, Homo sapiens
  misc_feature: GYAE6OF01CO1S5.25.86.H09.1.454.CMB.1.raw
  modified_base (218)..(218): a, c, t, g, unknown or other
  misc_feature (218)..(218): n is a, c, g, or t
  modified_base (363)..(363): a, c, t, g, unknown or other
  misc_feature (363)..(363): n is a, c, g, or t
  modified_base (448)..(474): a, c, t, g, unknown or other
  misc_feature (448)..(474): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggacaaaagggactacggtcagtcgtctcctcagccctaccaccgaagggccccagtccggtccttcccccgtggccgcccctgcctccaggacgccacctccgagacgcacgngccggccctggggctgcctggtacaaggtacctacttccacttacgtacagtctggacggcgggctgggacaaggcacgagtagnnnnnnnnnnnnnnnnnnnnnnnnnnn

SEQ ID NO: 19651 - DNA, 755 bp, Homo sapiens
  misc_feature: GYAE6OF01COB5S.25.86.H09.1.454.CMB.1.raw
  modified_base (288)..(288): a, c, t, g, unknown or other
  misc_feature (288)..(288): n is a, c, g, or t
tcagactgtacagtcacgaccggtgctcgatttagtgctatagacttaggtttgggggcaggagtcagacccactcaggacacagcatggacatgagggtccccgctcagctcctggggcttctgctgctctggctcccaggtgccaaatgtgccatccagttcgacccagtcctccactcctccctgtctgcctctgtcgagacatagtcaccatcacttggcgggctagtcgggtctagttggcagtgtctttagcctggtatcgagcaagaaaccgaggggaacncctacctagctcctgtacttcgtttagactcgccttaccgtaggtttaggaaggtcggtacgtaccctaatacgtaacgggttcaaggcggtacgacggtggtacgttacgtagggaactaggtaactttacacttccctacccaacctacgtaccgaacgaccgtaacggtcccgtacggacgtaccgtacccgttaaggaaaccttacgtttaccgtacgtaacccttaaaaccgtttaacgtttttaaccgttaacgttaaacccttaaaaacgttaaacggtttttaaacccggttaacccttttaacccccttaccgtttacccgttaccccgggtttacggggacccgggttaaacggggaaacccggttaagggggttagaacggttaaaccgttaaccgtaaaaacccggacggtttcgggtacgggtaccctttacggaacccgttaaaccggttacc

SEQ ID NO: 19652 - DNA, 592 bp, Homo sapiens
  misc_feature: GYAE6OF01AM9EM.25.86.H09.1.454.CMB.1.raw
  modified_base (422)..(422): a, c, t, g, unknown or other
  misc_feature (422)..(422): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctccgtgattctttgatcgcctcgtaggtttaggaaagttcggacgtcccagtcgtaaggttcaggcggcaggtggatcgtagggacagtactttcactcctacacatcagacagcctgcagtcctagaacgtnttcacgtactaaccgttatttacgttagtaactaaacttaagttttaacgtactttaccccgttcttaccgttccgttacgggaccgggtaacgggtaacccgtaaggggttaggaacggtactaaccgaaaaggtaccgttgggtacgtaccgtacgtcctaaccgtac

SEQ ID NO: 19653 - DNA, 696 bp, Homo sapiens
  misc_feature: GYAE6OF01BYCZI.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagcctggtatcagcagaaaccgaggggaanctacctaagctcctgatctttgatcgcctctagtttaggaaagtggacgtccatacgtaaggttcaggcggctaggtggactcgtagggactagtactttcacgttccctacacctatccgaacgcctaacggtccttagaccgacggtcccgtaaggtaaacgtacgtttaccgtacggtaaccctaaaccgttttagtttacgttacgttaaccctaaaacgtttaaacgttttaaaccggtaccttttaacccccgttacgttacccgttaccccggtttacggggacccgggtaaaccggggtaacccggtaaacggggttacgggaaacggttaaccgttaaaccgggtaaaaaaccggttaccggttacgggttacgggtacccgttacggaccccgtaaccgtttaaccg

SEQ ID NO: 19654 - DNA, 793 bp, Homo sapiens
  misc_feature: GYAE6OF01DHVHI.25.86.H09.1.454.CMB.1.raw
  modified_base (294)..(294): a, c, t, g, unknown or other
  misc_feature (294)..(294): n is a, c, g, or t
tcagactgtacagtcacgaccggtgctcgatttagtgctatagacttgggtttgggggcaggagtcagacccactcaggacacagcatggacatgagggtcccccgctcagctcctggggcttctgctgctctggctcccaggtgaccaaatgtcgccatcccagttcgacccagtctccatccctccctgtctcgcctctgttcgagacatagtccaccatccacttggtcgggctaggtcgggtcagttggcagtgctttagcctggtatcagcaagaaaccgaggggaacnctacctaagctcctgattctttgatcgtccctccgtaggtttaggaaagtcgggacgtaccctagtacgtaagggttaccacggtccggacgtaggtaggtaactccgggtaggggtaacctaaggttacttttaccactttacccctacctaacccgtaatcccgaaaggtcccgtaacggtacccttcggacccgaacggtcccgtaagggtaaacggttactttacccgtacgtaacccttaaacccgtttattttaaccgttacggttaaacccttaaaaccgtttaaacggtttttaaacgggtaaccccttttaacccccgtttccgttcccggtttaccccccggttttacgggggaacccggggttaaaccggggtaaaccccggttaaaagggggtagggggtaaaccgttaaaccgtaaacccgggtaaaaacccggtaacggtttccggggtacgttaccggtacccggacccttaaccccgttacgg

SEQ ID NO: 19655 - DNA, 422 bp, Homo sapiens
  misc_feature: GYAE6OF01BD35S.25.86.H09.1.454.CMB.1.raw
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (411)..(422): a, c, t, g, unknown or other
  misc_feature (411)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaagggactacggtcatcgtctcctcagcctcaccaggcccatcggtctcccctggccnccctgctccaggngcacctccgagngcacacgccgccctgggctgcctggcaaggctacttcactgtacagtctgacgcgggctggcaaggcgcagtagnnnnnnnnnnnn

SEQ ID NO: 19656 - DNA, 422 bp, Homo sapiens
  misc_feature: GYAE6OF01DRII4.25.86.H09.1.454.CMB.1.raw
  modified_base (396)..(396): a, c, t, g, unknown or other
  misc_feature (396)..(396): n is a, c, g, or t
  modified_base (413)..(422): a, c, t, g, unknown or other
  misc_feature (413)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtggggcaaagggactacggtcatcgtctctcagcctccaccagggccatccggtccttcccctggccgccctgcctcaggcgcacctccgagagcacagcgccctggctgcctggtcaaggtactacttcactggtacagtctgagcggntggacaaggcgcatagnnnnnnnnnn

SEQ ID NO: 19657 - DNA, 465 bp, Homo sapiens
  misc_feature: GYAE6OF01EPO5W.25.86.H09.1.454.CMB.1.raw
  modified_base (216)..(216): a, c, t, g, unknown or other
  misc_feature (216)..(216): n is a, c, g, or t
  modified_base (448)..(465): a, c, t, g, unknown or other
  misc_feature (448)..(465): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtttgaaggcggtgttgaggtgaatgcctggaacccccgnggtcagcactacttctacagtgggcgtcgtggggacaaagggctacggtcatcgtctcctcagcctccaccaagggcccatccggtccttcccccgtggccgccctgcctccgaggacgccacctccgagacgcacgacgcccggcccgtggggctcggccgtggtaccaacggtacctacttccactcgtacagtcgtggaggcgggcgtggacgaaggccgacagtacgnnnnnnnnnnnnnnnnnn

SEQ ID NO: 19658 - DNA, 605 bp, Homo sapiens
  misc_feature: GYAE6OF01CXN4E.25.86.H09.1.454.CMB.1.raw
  modified_base (283)..(283): a, c, t, g, unknown or other
  misc_feature (283)..(283): n is a, c, g, or t
  modified_base (427)..(427): a, c, t, g, unknown or other
  misc_feature (427)..(427): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctcatcctccctgtctgcctctgttcgagacatagtcaccatcacttgtcgggctagtcgggtcattggcagtgactttagcctaggtactcagcaagaaaccgaggggaanctacctaagctcctgatctttgatcgcctacgagtttggaaagtggacgtcccatacgaaggttcagtcgacgtaggtgaatcgtagggacagtactttacatccctacaccaatcgaagcacggcctagcacgcctagaactnttctacgaactaacccttattaattacgtaactaaaacgtaattttaaacggactttaacccctcttaccttcccgggttacgggacccgggaagggaacccgttaaagggtacggaagtaaactaaaccgaaaaccgttacgttacggtacggtacctacggacctaacccgtaacg

SEQ ID NO: 19659 - DNA, 447 bp, Homo sapiens
  misc_feature: GYAE6OF01B6L19.25.86.H09.1.454.CMB.1.raw
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (423)..(447): a, c, t, g, unknown or other
  misc_feature (423)..(447): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaaatggacagtctgacacctgatgacaccgccttgtattattgtgtgaaaggcggtgttgaggtgaatgcctggaacccccgcggtcagcactacttctacatgggcgtctggggcaaaagggactacggtcatcgtctcctcagcctccaccaaggcccatcggtcttcccctgcgccctgctccagancacctccgagngcacagccggccctgggctgccgtggtacaaggacctacttcccactgtacagtctgagcgggctggacaaggcgacaacgtagannnnnnnnnnnnnnnnnnnnnnnnn

SEQ ID NO: 19660 - DNA, 662 bp, Homo sapiens
  misc_feature: GYAE6OF01CLTYV.25.86.H09.1.454.CMB.1.raw
  modified_base (290)..(290): a, c, t, g, unknown or other
  misc_feature (290)..(290): n is a, c, g, or t
  modified_base (479)..(479): a, c, t, g, unknown or other
  misc_feature (479)..(479): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctaggtcgggtcagttggcagtgtcttttagccttggtatcagacaacggaaaccgagggggaacnccgttaccgtaacgtcctcctagtacttcgtttgactcgtcccgttacgtaggtttaggaagtacggtacgtacctagtacggtaaggttccgaggtccggtacgtaggtaggtacttcgggtagggaactaagttactttactactaccctacctaaccacgttacgaacgccacgtccctaggaccnccggtaccgtagaacgtacttcgtacgtaaccttaactttatttagttaaccgtaactaaacgttaacgtttaacgtacctttacccttccgttaaccgttccgggtacggacgggtacggacgtaagggtagaacgtacgtaacgtaaacgtacggtcggtacgactcggacctacgttacg

SEQ ID NO: 19661 - DNA, 650 bp, Homo sapiens
  misc_feature: GYAE6OF01CM19D.25.86.H09.1.454.CMB.1.raw
  modified_base (557)..(557): a, c, t, g, unknown or other
  misc_feature (557)..(557): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgttgcctattttaaaaggtgtccagtgtgaagtgcaacgtggtggagtcgtgggggagccggtgggtacgagggccgggggggtccctggagactctcctgtgtacgcctctggattcgattgtttgattgtattatgccatgcacgtcgggtccgtacgaaacggggtccggggaagggtcgtgggtacggttcgggttcctcgttctttagtggtacggttgggagtaggggaagtaaacgtaacctatagtgacagtacctgtggtaggaaggtcacttccaccacctaccgagacgaacaacatacgaacgtaacctcccgtagtactcgtagactaagtagactagtcgtacgacctacgtagtactacgacctacccgtcgttagttaacgttnttaggtggtaacgggtaagggtcggttaggttgggtaggttagtaacgtccggtacccggtacccgggtaaccccccggtggtaccgtaaccg

SEQ ID NO: 19662 - DNA, 684 bp, Homo sapiens
  misc_feature: GYAE6OF01EO605.25.86.H09.1.454.CMB.1.raw
  modified_base (676)..(676): a, c, t, g, unknown or other
  misc_feature (676)..(676): n is a, c, g, or t
tcagactgtacagtcacgaccggtgctcgatttagtgctatagacttgggtttgggggcaggagtcagacccactcaggacacagcatggacatgagggtcccccgctcagctcctggggcttctgctgctctggctcccgaggtgaccaatgtcgccatccagttcgacccagtcctccactcctcctgtctcgcctctgtcgagacatacgtcacctatcctacgttggtcgggctaggtcgggtctagttcgggctaggtcgttacgtttacgtccgtggtactcgagacgaaacgaaccggaggggaacgtcctaccgtaagtcctacctgtactttcgttagactcgtccctacggttaggtttaggtaagggtcggtaccgtcctagtacgtaaggtcgaggcggacgtaggtacggtacgtcggtacggacgtagttactttaccacgttccctacctaaccgtacacgtacgccgtaccgcgtacggacctacgtaccgtagtaacgttcttacgtccgtaacctacttaattacgttacgtaacttaacgttaaacgttaacgttccttacccttccgttccgttcgggtaccgggtaccgggaacgggtaaccgtagggtagaacgtaacgtaccgtaaaacgtccgtaggtcgaccgtcgtaccncgttaccg

SEQ ID NO: 19663 - DNA, 727 bp, Homo sapiens
  misc_feature: GYAE6OF01A4O18.25.86.H09.1.454.CMB.1.raw
tcagactgtacagtcacgaccggtgctcgatttagtgctatagacttggggtttgggggggagtcagacccactcaggacacagcatggacatgagggtccccgctcagctcctggggcttctgctgctctggctcccaggtgccaaatgtgccatccagttcgacccagtctccatccctcctgtctgcctcgtgtcgagacatagtccaccatcacgttcggtcgggctaggtcgggtctagttggctaggtgtctttagcctggtatcagcaaggaaaccgaggggaatcctactaacgcctcctgtacttcttgactcgtccctaccgtaggttacggaagtggactacccatacgaaggttcgacggcggacgagtggacgtcggtaggggactaggttactttactacgtccctacacctataccgacgacgtacggcccctaagcccgtaaggtcccgtaaggaaacggttacttcccgtacggtaacccttaaaccgttttatttaacgttaacttaaccgttaaaaccgtttaaacggttttaaacggttaacccttttaccccgttcgtttaccccggtttacccgggttacggggaacccggggtaaacgggtacccggttaaaaggggtcgggaaacctaacgtaaaccggtaaacggttacccgtagggtacggtaccctacgaacccgttaccgtacgtttcccgttacccgg

SEQ ID NO: 19664 - DNA, 680 bp, Homo sapiens
  misc_feature: GYAE6OF01CXH70.25.86.H09.1.454.CMB.1.raw
  modified_base (293)..(293): a, c, t, g, unknown or other
  misc_feature (293)..(293): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccatcacttggcgggctagtcgggtcagttggctagtcgtcttttaggccttggtactcgagacaaggaaaaccgaggggaacnctaccgtaagcctcctgacttcttgatcgcctcgtagtttggaaagtggacgtccagtaccgaaggttcgaggtcggacgtaaggtggagtcggtagggacaggttacttcattcccacaccctagtacaacgggacctacgtccctacggccctacgtccgtaagtacgtactttccgtacgaccttaaacctttagttaacttacggtaaccttaaactaagttttaaccggtaaccttttaccccgtacgttacccgtttacccggttaccggggacggggttaaccgggtaacccggtaaaggggttacggggaaacgtaaacgtaacccggtaaaacggaacgttcgggttacggtaccttccggaacccgtacccgttacg

SEQ ID NO: 19665 - DNA, 508 bp, Homo sapiens
  misc_feature: GYAE6OF01BPOL1.25.86.H09.1.454.CMB.1.raw
  modified_base (217)..(217): a, c, t, g, unknown or other
  misc_feature (217)..(217): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (474)..(480): a, c, t, g, unknown or other
  misc_feature (474)..(480): n is a, c, g, or t
  modified_base (482)..(482): a, c, t, g, unknown or other
  misc_feature (482)..(482): n is a, c, g, or t
  modified_base (484)..(508): a, c, t, g, unknown or other
  misc_feature (484)..(508): n is a, c, g, or t
tcagactgtacagtcacgaccggtgctcgatttagtgctatagacttgggtttgggagaagaaccctactatgcagactctgtgaagggtcgattcaccacctccagagacaacatcaagaactccctgtatctgcaaatggacagtctgacacctgatgacaccgcttgtattattgtgtgaaggcggtgttgaggtgaatgcctggaacccccgnggtcagcactacttctacatgggctcgtggggacaaagggctacggtcatcgtctcctcagccctccaccgagggccccagtcggtccttcccccgtgccgccctgctccaggcnccacctcgagngcacgngccggcctgggctgcccgtggtaccgaaggtaccttccttaccgacgttcgtacgagttccgtaggacggccggggtaccgtacgggacccgaaacgggtccggacaaagttacngtangatcgnnnnnnngngnnnnnnnnnnnnnnnnnnnnnnnnn

SEQ ID NO: 19666 - DNA, 582 bp, Homo sapiens
  misc_feature: GYAE6OF01EJJFS.25.86.H09.1.454.CMB.1.raw
  modified_base (576)..(576): a, c, t, g, unknown or other
  misc_feature (576)..(576): n is a, c, g, or t
tcagactgtacagtcacgaccggtgctcgatttagtgctatagacttgggtttggggggcaggagtcagacccactcaggacacagcatggacatgagggtccccgctcagctcctgggggcttctgctgctctggctcccaggtgccaaatgtgccatccagttgacccagtctccatcctcctgtctgcctctgttcgagacatagtcaccatcacttgtcgggctagtcgggtctagttggcagtgctttagcctggtatcagcaagaaaccgaggggaagctacctaagctcctgattcttgatgcctcgtagtttaggaaagtggacgtccatacgaaggttcaggcggcgaggtggatcgtgggaacagtagtttcactccctacacctatcagtcacgcctgccacgcctagaacgtattcgtcgacctaaccttattagttagactaaacgttaagttttaacggtaccttacccttaccgtccgttccgttacgggacgggtaacgggaccgtaagggtaggaacgtaacgtaacgtaaacggtacgttaggacggtacctgacccncgtacg

SEQ ID NO: 19667 - DNA, 518 bp, Homo sapiens
  misc_feature: GYAE6OF01D8T49.25.86.H09.1.454.CMB.1.raw
  modified_base (427)..(427): a, c, t, g, unknown or other
  misc_feature (427)..(427): n is a, c, g, or t
  modified_base (487)..(518): a, c, t, g, unknown or other
  misc_feature (487)..(518): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgcttgtattattgtgtgaaaggcggtgttgaggtgaatgcctggaacccccgcggtcagcactacttctacatgggcgtcgtgggggcaaagggactacggtcatcgtctcctcagccctccaccgaagggcccctatccggtcctttcccccgtgggccgcccctgcctccgaggacgccacctccgagagcacgagccggccgtggggcctggcccttgggtaccaaacgggtaccttaccttcccgaacttcggtaaccncggttccgttggaacgggtccggggtctcggggaccgaaacgggccgacgaagttaggcnnnnnnnnnnnnnnnnnnnnnnnnnnnnnnnn

SEQ ID NO: 19668 - DNA, 439 bp, Homo sapiens
  misc_feature: GYAE6OF01A62ZS.25.86.H09.1.454.CMB.1.raw
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (430)..(439): a, c, t, g, unknown or other
  misc_feature (430)..(439): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaagggccccatccggtccttccccctggccgccctgcctccagggagccaccctccggagacgcacgagccggcccgtgggctgcctggtcaaggactacttccactgtacngtctgagcgggntgggcaaggcganatagnnnnnnnnnn

SEQ ID NO: 19669 - DNA, 666 bp, Homo sapiens
  misc_feature: GYAE6OF01DKUFL.25.86.H09.1.454.CMB.1.raw
  modified_base (285)..(285): a, c, t, g, unknown or other
  misc_feature (285)..(285): n is a, c, g, or t
tcagactgtacagtcacgaccggtgctcgatttagtgctatagacttgggtttgggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttgggctagtgtctttagcctggtatcagacaagaaccgagggaacnctacgtaacgctcctgattcttgactcgtcctcgtaggtttaggaaaggtcgactccagtcgtaacggttcgacggcggacgtaggtggtactcggtagggtactagttatttaccacttcctacaacctataccgagtaccacgctcgacgacgtcctagacgtacttcgacgtaccttaaacttatttaacgttacgtaactaaaacgttaacgtttaaaccggtacctttaaccccgttcgtttaccccgttaccggttaccgggggaaacggtaaccggggtaacccgtaaggggttacggtaaacggtaaccgtaaaccggaaaccggttacgtgggtacggtacctacgaacccgtacttaaccgttcgttaccg

SEQ ID NO: 19670 - DNA, 594 bp, Homo sapiens
  misc_feature: GYAE6OF01A9H1D.25.86.H09.1.454.CMB.1.raw
  modified_base (285)..(285): a, c, t, g, unknown or other
  misc_feature (285)..(285): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacctatcacttgcgggctaggtcgggtcagttggcagtgtctttagcctggtatcagcaagaaaccgaggggaacnctcctaagcctcctgacttctttgatcgcctactagttggaaagtggactccatcgaaggtcagcggcaggtgagtcgtgggactaggtactttcgactccgtacactagtcagcacgcctgacgacgccgtagaacgtacttcgtcgacctaaaccgttatttacttacgtaactaaacgttaacgtttaacgtactttaccctcttaccttccggttacgggaccgggtaaggtaacccgtaggggtagaacgtaacgaaccgtaaacggaacgttcggtaccggacgtacgaacccgtacgtaacg

SEQ ID NO: 19671 - DNA, 660 bp, Homo sapiens
  misc_feature: GYAE6OF01CNV8N.25.86.H09.1.454.CMB.1.raw
  modified_base (312)..(312): a, c, t, g, unknown or other
  misc_feature (312)..(312): n is a, c, g, or t
tcagactgtacagtcacgaccggtgctcgatttagtgctatagacttggggtttgggggggagtcagacccactcaggacacagcatggacatgagggtccccgctcagctcctggggcttctgctgctctggcctcccaggtcgaccaaatgtgccatcccagttcgaccccagtcctccatccctccctgtctcgccttctgttcgagacatagtccaccatcacgtttgtcgggactagggtccgggtctagttggcagtgtactttacgccgttaggtaataacgacaacggaaaaccgaggggaacncctaccaagtcctctagtattcgttgactcgcctacgtagttaggaagtcggtactcctagtagtaacggtcaggtcggacgtaggtagtacgttcggacggtaactaggtactttacctacgttaccctacgtaacctacgtcgaacgccgtaaccgtccgtacgacgtacgtaccgtagtacgttacttcgacgtaactaaccgttattataacgtaacttaaactaagtttacgtaaccttccttccgtaccgttcgtaccgggacggtaacgacggtaaggtagaagacgtaacgaaacgtcgttaggaccggtactacgaccgtaccttcgtcgttgttaccc

SEQ ID NO: 19672 - DNA, 622 bp, Homo sapiens
  misc_feature: GYAE6OF01DLZ8F.25.86.H09.1.454.CMB.1.raw
  modified_base (373)..(373): a, c, t, g, unknown or other
  misc_feature (373)..(373): n is a, c, g, or t
tcagactgtacagtcacgaccggtgctcgatttagtgctatagacttgggtttggggggcaggagtcagaaccactcaggacacagcatggacatgagggtccccgctcagctcctgggggcttctgctgctctggctcccaggtgccaaatgtgccatccagttgacccagtctccatccctccctgtctgcctctgttcgagacatagtccaccatcacgttggtccgggctagggtcgggtcagttggcagtgtctttagcctggtatcagcaagaaacgagggagctaccgtaagcctctgacttcttgactcgtcctcgtaaggttaggaaacggtcggacgtcccagttacgaaggttcacggcggnaggtggtatcggtagggactagtactttacacgtcctacaccgatcgacgcctacgcctagccacgtcctaggaactcgttaccgtcaccgtaaccttatttacttacgtaactaaattaacgtttaacgtacctttaccctcgttacccgttccggttacgggccggggtaaacggaccgggtaaagggtaggaacgtaacgtaaaccggtaaacgtacgttcggtacggcttacgacccgtcttacg

SEQ ID NO: 19673 - DNA, 450 bp, Homo sapiens
  misc_feature: GYAE6OF01DFBSO.25.86.H09.1.454.CMB.1.raw
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (431)..(431): a, c, t, g, unknown or other
  misc_feature (431)..(431): n is a, c, g, or t
  modified_base (437)..(450): a, c, t, g, unknown or other
  misc_feature (437)..(450): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgatgcctggaacccccgnggtcagcactacttctacatggggcgtcgtgggggcaaaagggctacggtcatcgtctcctcagcctccaccaagggccccatccggtccttccccgtggccgcccctgcctccagggacnccaccctccgagacgcacgcgccggccctggggctgcctggcaaggccttactccactgtacagtcgtgaggcggcgtgggacaagggccganagtagnnnnnnnnnnnnnn

SEQ ID NO: 19674 - DNA, 727 bp, Homo sapiens
  misc_feature: GYAE6OF01DK29I.25.86.H09.1.454.CMB.1.raw
  modified_base (712)..(712): a, c, t, g, unknown or other
  misc_feature (712)..(712): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatccctccctgtctcgtccttctgttcgagacatagtcaccatcacgttgcggctaggtcgggtcagttggcagtgtctttagcgtggtatacacgacaagaaaccgaggggaagtcctaccgtaacgctccgtgtacttctttagtcgtcgtcccgttaccgttaaggtttaacggtaaacggtttcgggaaccttacccgtaagttaaccgtaaacgggtttccgaacggtacgggacgtaacgggtggtacgttaccggtagggtaccgtaggttactttactaacctccgttacccactacgtacgaacggctaacggtcctcggaccgtaaccggtaccgtaagtaaacgtttctttaccgtacgtaaccttaaccgtttaatttacgtttaacggaaccttaaaccgtttaaagtttaaccggttacctttaccctttacggtccgtttacgtaccggggtacggaacggtaaaccggttagggacggtaacgtaacgttaaaccgaaacggtcgtacggtacggttacncggtaaccctcgtac

SEQ ID NO: 19675 - DNA, 514 bp, Homo sapiens
  misc_feature: GYAE6OF01CEGGA.25.86.H09.1.454.CMB.1.raw
  modified_base (218)..(218): a, c, t, g, unknown or other
  misc_feature (218)..(218): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (478)..(478): a, c, t, g, unknown or other
  misc_feature (478)..(478): n is a, c, g, or t
  modified_base (482)..(514): a, c, t, g, unknown or other
  misc_feature (482)..(514): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccccgnggtcagcactacttctacatgggcgtcgtgggggacaaagggctacggtcatcgtctcctcacgccctccaccgaacggccccagtccggtccttcccccgnggcccgccctcgcctccgaggcnccaccctccggagacncacgacggccggtccgngggcctcgccgttggacaacggtaccttaccttcccacgttacgtacctaggtcctaggacgggtccgggacgtgggaccgtaacgggccgacgtagtagcngcgnnnnnnnnnnnnnnnnnnnnnnnnnnnnnnnnn

SEQ ID NO: 19676 - DNA, 761 bp, Homo sapiens
  misc_feature: GYAE6OF01BPWT6.25.86.H09.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (412)..(412): a, c, t, g, unknown or other
  misc_feature (412)..(412): n is a, c, g, or t
tcagactgtacagtcacgaccggtgctcgatttagtgctatagacttggggtttggggggagtcagacccactcaggacacagcatggacatggacgggtcccccgctcagctccgtggggcttctgctgctctggcctcccaggtcgccaaatgtcgccatccagttcgaccctagtcctccacttccctccctgtctcgcctctgtcganactatacgtccactatcctacgttggtcgggctaggtcgggtctagttggctaggtntcgttacggtcgtggtactcgacgcgaaacggaaccggagggtacgtaccttacgtaagtcctcgtgtacttcgtttgactccgtcctacgttaagggtaggaacgtggtacctccagttacgacggtacgcgggtaccgtanacggtcggtactcgggtacgtacgtattacttacacccgttcaccctacgtactcgacgccgtacgtaccgtacgacgtaccggtacgtaacggtacgttacttaccgttaaccgtaacctttaaaccggtttaattaaccgttttaacgtaaacctttaaaacttaaccggtttaaaccgttaccccttaacccgtttcgtacccggtttaccgggtaaccggggtaacgggtaaccggtaaacgggtaaagggtacggggtaaacgtaacccggtaaacggtaaacggttcggttacggccgggtaacccttggaacccccgttacttccgggttcctttaacccgg

SEQ ID NO: 19677 - DNA, 982 bp, Homo sapiens
  misc_feature: GYAE6OF01DQWEV.25.86.H09.1.454.CMB.1.raw
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgttgacctaattttaaaggtgtccagtgtgaagtgacaacgtggtggagtcggtgggggacgccgtggtcaacggccggtcggggggtacccgaagtacctctcgttgtcgcacgccttcgtaggtacttacctaaccttacgaaaggtctaacagacatacgaacgtggtactcccggaccgacggggtccggtacccggggggtaaggtcgtacggcgtaggttcggtacttttaccacgttacccgtaagtttacggttcggttaccgtttaaacggtccggttaagttaaacctttaaaagtttttacgtacggtaccgtaacgggtaccggttaccgggggttaaccgggtaaaaccccggggttccccggttttaacccgaaccccgttacgttaccccgttaaccccggtaaacgggaaacccgggtaaaccccggaaaaccccgggtacccccggtaaacccggttttaaccccttttttacccgtttacccgtttttacccgttaacggttaaacccgtaaaaaccggttaacggtaaacccgtaacccggtaccccgttaaccgggaacgggaacccgggtaacccgggaaaccgggtaaccccgggtaaccgggtttacccgttttacggttttttaaccgttttccggttaggggttaccgggtaccggggtaaacgggtaagggggttaacggggttaaccgggggtaaacccggttaaaaacgggttcgggttaccgggttaccgggttaaacggggtacgggttaacggttacggtttaccgggtttacggttttacggtttaaccgggg

SEQ ID NO: 19678 - DNA, 942 bp, Homo sapiens
  misc_feature: GYAE6OF01D2TQX.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctcgtggctccaggtgccaaagtgtcgcctatccgagttcgacccagtcctccactccctcctgtctcgccttcgtgttcgagactagtacgtcacctatctacgttggtaccggtcttaggtccgggtactagttcggctaggttcgttacctttacgtccgttaggtactaccgacgtacgaaacggaaaaccggtaacggggtaaaccttaccgtaacgtacccttaccgttacggtaacgtttacgtttacgtaacggttcggtacccgtttaccggtagggttttaagggtaaacgggttcggttaaccttacccgtaggttacggttaaacggttaccggacggtacgggtaccgttaagggttaggtacgttacgggttacgggtaacgtaacgtttacgtttaaccgtccgttaacccgttacccaaccttaaccggttaccgaaccggtaccggtacctaccccgggtaacgacccggtaacgttaaccggtaaacggttaactttacccgttttccgaacggtaaaccctttaacgttttagtttaaccgtttaacgaaaacctttaaacggttttaaacgttaacccgggtttaacccctttactttaccccggtttccgttaacccgggggtttaccggggaaaacgggggtaaacccggggttaaacccgggttaaggggtaaaccgggtaaaccgttaaacccgggttaaaaccaaaacggggttttcgggaccgttttaccgggaaccttccgggtaaccccttaacggttaaccctttgggggttaccccttttacccggg

SEQ ID NO: 19679 - DNA, 718 bp, Homo sapiens
  misc_feature: GYAE6OF01C38HW.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccactccctccctgtctgcctctgtcgagacatacgtccacatctacgttggtcgggacttaggtcgggtctagttggctaggtcgtacgtttacgccgtggtatcgacgacgaacggaaaccggaggggaactcctaccgtaacgtccttccgtagtacttcgtttcgactcgtaccttacgtagggtttaacggaaaggttcggacgtacccaagttacggtaacggttcgacggtacggacgtagggtaggtacgtcgtaggggactaggttactttcgaccgttcccactaacctcgtacgacgcacggtcctacgacgaccgtactaacggtaaacgtcttacgtacgtaaccttaaccgtttaagtttagtaaccgttaaaccttaaagtttaacggtttaaccgtacccttttacccctcggtttacccttccgggtacgggaccgggtaacgggaaaccttacgggggtactaaacggtcttaaaccggaaagttcccgggtagtacgggtacctccggtaaccctacgttaccg

SEQ ID NO: 19680 - DNA, 984 bp, Homo sapiens
  misc_feature: GYAE6OF01DO013.25.86.H09.1.454.CMB.1.raw
tcagactgtacagtcacgaccggtgctcgatttagtgctatagacttgagctctgggaaaggacgccccagccctgagattcccaggtgattccattcggtgatcagcactgaacacagaactcacatggtagttgactgagtcgttgggttttccttgttcgaccttaagtttttaaaaggtcgtaccgtaggtggtagaaagtgactaaacgttgggtgggtaggttcgggtgggggggacgtccgggttgggtaaccggacgggggtcccggggggggtccctggacgtaccttccgtccgttggtcggtacgtccttcgtggtatttcgtagtttggttttagattggtaactttagtcggtaccctagttcggtaccgtaccgggtttccgggggtaccccggttaacgggtaaaccggggggggttacccgggggggtaaacggggttccgggttaggggggttaacgggtttccggggtttacccttttccgttttaccggtttaaggttacgggttaacggggttttagggggaagggttaacggggggaaaacgtaaaaccggttaaaacccgtttaacgtaaggttacggtaacccgtaacggttaccgtttacgggttaagggtaaacggggttaaacgggttcccgttaactttaccccgaaccccgttaccgtaacccgaaaggaaccgtaaaacctaaaccgtaacgttaaccgtaaaaccgtacccctttacccgtaagtttaacctacgtaacgaacgttaaacgtccggtaattccgggtacctaacgtaacccgtacgttaacgtaaccggtaaccgtacccgttaacccggtttcgttttaaaggtacttttacgggttcgggttaaagggtaacgggttaaggggttcgggtttaggtttaggggaaggttaacgtacggtcccggaccccggttaacccgggacccccggttgaacccgtacg

SEQ ID NO: 19681 - DNA, 517 bp, Homo sapiens
  misc_feature: GYAE6OF01DXM4I.25.86.H09.1.454.CMB.1.raw
  modified_base (217)..(217): a, c, t, g, unknown or other
  misc_feature (217)..(217): n is a, c, g, or t
  modified_base (357)..(357): a, c, t, g, unknown or other
  misc_feature (357)..(357): n is a, c, g, or t
  modified_base (494)..(494): a, c, t, g, unknown or other
  misc_feature (494)..(494): n is a, c, g, or t
  modified_base (496)..(517): a, c, t, g, unknown or other
  misc_feature (496)..(517): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgaccaccgcttgtattattgtgtgaaggcggtgttgagtgaatcgcctcggaacccccgnggtcagccactacttcactagtggggcgtcggtggggacgaaagggactacggtcagtccgtctcctcacgccctccaccgaacgggcccctacgtccggtcccttcccccgtggcccgccccgtgccgtccgacggacnccgacccgtaccgagcgaccacgacgcccggccgtgggcctggtcccgtaggtacccgtaaggtacccttaccgttccacgttacgtacgtacggttctagggacggtccgggcgtacgggaccgacggcgctaagngnnnnnnnnnnnnnnnnnnnnnn

SEQ ID NO: 19682 - DNA, 533 bp, Homo sapiens
  misc_feature: GYAE6OF01DCB3O.25.86.H09.1.454.CMB.1.raw
  modified_base (505)..(533): a, c, t, g, unknown or other
  misc_feature (505)..(533): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacacccgccttgtattattgtgtgaaaggcggtgttgaggtgaatgcctggaaccccgcggtcagcactacttctacatgggcgtcgtggggacgaaaagggactacggtcatcgtctcctcagcctccaccgacgggcccagtccggtccttcccccgtggccgccccgtcgcctccgagggacgccaccgtcccgaagacgcacgacggccgggcccgtgggccttcggccgttcgggtaccgtaaacggaccgtttacccttccctaacgttcggttaaccgtacggtttccgtagggaacgggtccggggttcgaggggaccgaaacgggccacgaattggnnnnnnnnnnnnnnnnnnnnnnnnnnnnn

SEQ ID NO: 19683 - DNA, 638 bp, Homo sapiens
  misc_feature: GYAE6OF01EVPB6.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtccgggctagtcgggtcagttggcagtgctttacgcctggtatcaacagaaaccagggagagttcctaagctcctgatctatcgctcgcctacctacgttacacgtccgtacggggtccccagttccgtcggtcgtagcggtcaaggtgaactcgtgggacgagtacgttctaactctactactactctacgcagccctgaccacgtccgttagaatagtcgttacgtactaactttaattacgttaagtaaccaaaaggttaacttaacgttactaccgtaccccttcgtaccgttaccgtttaccgggaccggggtaacgggtaacccgtaaaggggtacggaacggttaacgtaaacccggtaaaacggtaaaccggttagtttacccgggacctttcgggaaccctaaacccgg

SEQ ID NO: 19684 - DNA, 596 bp, Homo sapiens
  misc_feature: GYAE6OF01CPX00.25.86.H09.1.454.CMB.1.raw
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(544): a, c, t, g, unknown or other
  misc_feature (540)..(544): n is a, c, g, or t
  modified_base (547)..(547): a, c, t, g, unknown or other
  misc_feature (547)..(547): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (588)..(591): a, c, t, g, unknown or other
  misc_feature (588)..(591): n is a, c, g, or t
tcagactgtacagtcacgaccggtgctcgatttagtgctatagacttgggttgggagggaagaacctactatgcagactctgtgaaggtcgattcaccacctccagagacaacatcaagaactccctgtatctgcaaagtggacaggtctgacacctgatgacaccgccttgtacttattgtgtgaaaggcggtgttgaggtgaatgccgtcggaaccccgcggtcagcactacgttacacagtgggtcgtcgtggggactaaaggacgttacggtctacgtcgtctcctcacgcctaccaaccgaacggccctactccggttacctttccccgtggccgccctagcctaccgacggacgtccgtaaccgtccgagacgtcacgacgccggcccgtagggcctcggccgttacggaccgtaacgggtacccttaacgttccctaacgttcgttaaccgtacggtttcccgaggaccgggtccggggtacttacggggaacccgaaacggggtcctaactaagtttaggacaggngngngnnnnnganagagtagtgtgngngcgagcgngcgngcgncgcncgncgcnnnncgctc

SEQ ID NO: 19685 - DNA, 772 bp, Homo sapiens
  misc_feature: GYAE6OF01BMWWA.25.86.H09.1.454.CMB.1.raw
tcagactgtacagtcacgaccggtgctcgatttagtgctatagacttgggtttgggggggacacctggggacactgaactggtgctgagttactgagatgagccagccctgcagctgtgtccagcctgcccatcctctgctcatttgcatacttcccagaacacaacctcctgccctagaagacttcttagtaggctggtcactacttcttgcaggatcacgacccactcgaggaccagagctatggacagtcggacgggtcccgctcgacgtccgtccgtggggtcctttcgtcgtccgtcgtccgttccgtcgggtccgtaccccggtacgggtaccggtaccctaaaacggttcggtaccggtacccctaaccgttacccggttaaccggtttacccgaaccccggttaaccgtttacccgttaccccttaccctttcccccgtttccccgtcggtttacccgtccgttccccgttcggttccgggtttaccggaaaccgtaactaacgttaccggtaccctaacccgtacgtttaccgttaaccgttcggggttccgggtacgttaacgggttcggtaccgtagttcggacgttacggtcgttaccgtttacgcggttcgttacaccgacggaacgaacggtaaaaccgggacggggtacttaaccggtacctaccgtcgttctaacggttctttcgttgaccttccggtaccgttacggttagggtttaaacggaggttaccggacttaaccgcgttcgggtaacgg

SEQ ID NO: 19686 - DNA, 800 bp, Homo sapiens
  misc_feature: GYAE6OF01EKS15.25.86.H09.1.454.CMB.1.raw
  modified_base (788)..(788): a, c, t, g, unknown or other
  misc_feature (788)..(788): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttcgacccagtcctccactcctccctgtctcgtcctcttgttcgagactatacgtccacctatcctacgtttggtcgggtcttaggtcgggtctagttggactagttgtctttacgccttggttactcgagacgaacgtaaaccggagggggaaactccgtaccgtaacggtccttaccgtcgttaacgtttccgttttacggacgtttcccggtaccctttaccggtttaaggggttttaacgggtaaaacggttacgggtaaccccgttacccgtaacgtttaccggtaaaacgggtttccgaaacggggtcccggtaaccggtagggttacgggtaacggttaccggttaacgggggtaccttaacgggtttacctttacccgtaaaccttaccccgtaacctaccctaacggttacccgaacggtaccctacggtaccccgtagaccgtaacggtaccctagggtaacttacgttacctcgtaacccttaatttacgtttagtactaactaaaccttaaggttacctaccgtttacccacttcccgttacgccgggtaacgggacggtaccgtaagggtacgaacgtaagtaaccaaaccggtgtcgacgggtacacgacgtaacngttcccgttacg

SEQ ID NO: 19687 - DNA, 694 bp, Homo sapiens
  misc_feature: GYAE6OF01EUW1C.25.86.H09.1.454.CMB.1.raw
  modified_base (251)..(251): a, c, t, g, unknown or other
  misc_feature (251)..(251): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttcgacccagtctccatcctccctgtctgcctctgttcgagacatagtccaccatctacttggtcgggtctaggtcgggtcagttggcagttntcgttacgtcctggtatcgagacgaacgaaaccgaggggtaacacgtaccgtaacgcctcctagtacttcgtttgactcgtccttacgttaggtttagggaagtcggtacgtaccctagttaccggtaaacggttcgaacggcggtacgtaggtggtaacgtcggtaggggtactaggtacttttaccactttacccacgtaacctacgtacgtagccacggtcccgtacgccgtacggtacctaggtaacgtacttacgacgtacctaacgttttattaacgttacgtaacttaaacgttaaacgtttaccggtacctttacccttaccgttaccgttaccgggttaccgggacggtaacgggttaccgaaaggggtcgtaaacgtaacgtaacggtaaacggtacgtaggtcgtacctacggacctaactgtaccgtttcg

SEQ ID NO: 19688 - DNA, 716 bp, Homo sapiens
  misc_feature: GYAE6OF01CO9XK.25.86.H09.1.454.CMB.1.raw
  modified_base (289)..(289): a, c, t, g, unknown or other
  misc_feature (289)..(289): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctaggtcgggtcattggcagtgtctttacgctggtatcaggcgaacgaaaccggagggggtaacnccttaccgtaacgtcctcccgtagtacttcttttggacttcgcccttaccgtaggtttaggaaagtcgggactcccgtagtaccgtaaacgggttcacggcggacgaggtcggtaacgtcggttacgggactacggttactttccgacttccctacaacctactacacgaccacggtcctacggaccgtacgtaccgtaagtaacgtacttaccgtacgtaaccctaaccctttagtttaacgttacgtaaaccgtaaacgttaaccggttttaacggttaccctttaaccccgttcttaccccggttaccgggttccgggaaaccggggtaaccgggtaaacggtaacgggtagggtaaacgttaaccgtaacccgttaaaaaggtccgttacggggtcgtactaaccggtccctaaccgttaccg

SEQ ID NO: 19689 - DNA, 799 bp, Homo sapiens
  misc_feature: GYAE6OF01BQYZD.25.86.H09.1.454.CMB.1.raw
  modified_base (128)..(128): a, c, t, g, unknown or other
  misc_feature (128)..(128): n is a, c, g, or t
tcagactgtacagtcacgaccggtgctcgatttagtgctatagacttgggtttggggggagtcagacccactcaggacacagcatggacatgagggtccccgctcagctcctggggcttctgctgctntggctcccaggtgccaaatgtgaccatcccaggttcgacccagtcctccctactccctccctgttcctcgtccttcgtgttcgagacatacgtccactatctacgttggtcggctaggtccgggtctagttcggctaggttcgtcgtttacgccgtggtactcgagacaaggaaaccggtagggaactcctaccgtaacgtccttaccgtagttacttcttggtactccgtaccgttaccgttaagggtttaggaacggttacggtacgtaccctaacgtaccggtaacggttccgacggtaccggtcgaagggttacggtagttcggtaacgggacttaaggttactttacgacctttaccctaccgtaaccgtacgttacgaccgttaccgtaacgtccccgttaggccgaacgttaccgtaagggtaacttcgttaccgtaactacgttaaacctttagtttaaccgttaacgaaaccttaaacgttttaaaccggtttaacgttaccctttacccgttactttaccccgggttacccggttaacgggggaacggtaaaccgggtaaaccggtaggggttaaccggaacgttaacgtaaacccggtaaacggtacccggttaggttaccggacccgttacgttaaccaccggttccttacggttaccc

SEQ ID NO: 19690 - DNA, 775 bp, Homo sapiens
  misc_feature: GYAE6OF01B0QS0.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtcgccatccagttcgacccagtctccactcctccctgtctcgtcctctgttcgagactatagtccaccatctacgttgtccgggctaggtcgggtctagttcggctagtcgtcgtttacgccttaggtactacgacgacgaacggaaaccggaggggacgtcctaccgtaacgtccttccgtagtacgtttcgtttacggaactccggtacccttaccggttaagggttttaacgggaaacggttcgggtaaccgttacccgtaaggttaaccgtaacgggttcgaaccggcgggtacgtaagggtcggtacgttacggtacggggaacttacggttactttacgaaccttccctaccgaaccgtacgtaccgacgtaccgtaaccgtccgtacgaccgtacgtccgttaaaggaattcctttaccaaccggtaacttaaccttttagttacgtttacctaaacgttaaaccgtttaaaggtttaaccgttaaccttcccgttcgttaccccgtaccggggttaccgggaaacgggtaccgggtaacggtaacgggttagaacttaaacccgaacgttaaaccggtcgggttacggtacgtacccgtacgacccgtcttaacgg

SEQ ID NO: 19691 - DNA, 856 bp, Homo sapiens
  misc_feature: GYAE6OF01BDWBM.25.86.H09.1.454.CMB.1.raw
tcagactgtacagtcacgaccggtgctcgatttagtgctatagacttggggtttgggggcaggagtcagacccactcaggacacagcatggacatgagggtccccgctcagctcctggggcttctgctgctctggctccaggtgccaaatgtgccatccagttgacccagtctccatcctccctgtctgcctctgttcgagacatagtcaccatcacttgtcgggctaggtcgggtcagttggcagtgctttagcctggtatcgagcaacggaaaccgaggggaacgcctaccgtaaggtccttaccgtaggtactttccgtttagacgttccggtcccttaccggtaaggttttagggaaaacggttcgggaccgttacccgtaagttaccggtaaacgggtttccgaacggccgggtaccgtaagggttacgggtacgttacccgggtaggggtaaacgtaacgggtttaacgttttccgaacctttaccccgttacccgtaaaccctaacgtttaccgaaaacggtccccgtaaacggtcccgtttacgggaaccctaacggtacccgttaagggtaaaccgttactttaccgtaaccggtaaccttaaaacccgttttagtttaacgtttaccggttaaaccctaaaaccgtttaaacggttttaaaccgggttaacccttttaacccccgttaccgtttacccggtttacccggttaccgggggttaccgggggtaaaaccggggttaacccgggtaaaacggggttacgggaaaccgttaacggtaaaacccgtaaaacggtacccggttaacggtcgggtaccgttacgggaaccttacccgttaacgg

SEQ ID NO: 19692 - DNA, 594 bp, Homo sapiens
  misc_feature: GYAE6OF01A1N1E.25.86.H09.1.454.CMB.1.raw
  modified_base (387)..(387): a, c, t, g, unknown or other
  misc_feature (387)..(387): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctcccctgtctgcctctgttcgagacatagtcaccatcacttgtcgggctagtcgggtcagttggcagtgctttagcctggtataagcagaaaccgaggggaagctcctaagctcctgatctttgatgcctcctagttgaagtgatccatcagttcagcgcagtgatcgtggacagtatttcatcctcactatcagcacgcctgccagtccngaacgtattcgtgacctaaccttatttaacgttacgtactaaacgttaaagttttaaccggtaacctttaccccttaccttaccttacccggttaccgggtaccggggtaacgggaacccggtaaaggggtacgggtaaagtactaaccggaaaacggacgttacggtcggtacgtccggacctaaccctacttccgttggttaccc

SEQ ID NO: 19693 - DNA, 498 bp, Homo sapiens
  misc_feature: GYAE6OF01DAX1Y.25.86.H09.1.454.CMB.1.raw
  modified_base (350)..(350): a, c, t, g, unknown or other
  misc_feature (350)..(350): n is a, c, g, or t
  modified_base (478)..(498): a, c, t, g, unknown or other
  misc_feature (478)..(498): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaaatggacagtctgacacctgatgacaccgccttgtattattgtgtgaaaggcggtgttgaggtgaatgccctggaacccccgcggtcagcactacttctacatggggcgtcgtgggggaccaaaagggactacggtcatcgtcctcctcaacgccctccaaccgaacgggccccatccggtccttcccccgtggccgccctgcctcgaggacnccaccctcgaagagccacgacggccggccgtgggcctcgccgtcggtaccgaacggtaccttacttcccagttcgaacctggtacctgggacggtccggggcgtcgggaccgaagggccgacgatagnnnnnnnnnnnnnnnnnnnnn

SEQ ID NO: 19694 - DNA, 704 bp, Homo sapiens
  misc_feature: GYAE6OF01CTMFB.25.86.H09.1.454.CMB.1.raw
  modified_base (235)..(235): a, c, t, g, unknown or other
  misc_feature (235)..(235): n is a, c, g, or t
tcagactgtacagtcacgaccggtgctcgatttagtgctatagacttgggtttggggggagtcagacccactcaggacacagcatggacatgagggtccccgctcagctccgtggggcttctgctgctctggctcccaggtgccaaatgtgccatccagttcgacccagtctccatcctccctgtctgcctctgtcgagacatagtcaccatcacgttgtcggctaggtcgggtnagttggctagtgtacgtttagccttggtatcagacaacggaaccggaggggaagctacgtaacgtcctcctgtactctttgacttcgcctcgtagttaggaaacgtggtacgtccctagtacgtaaaggttcgaacggtcggacgaggtaggtacgtcggtagggtactaggtactttacacgtacccttacaacctagcgacgtaccaggtccctacgacgtaacgtccgtaagaaacggtcttccggtacaccttaaaccgtttaattttaacgttacggttaaaccttaaacgtttaaacgttttaacccggtacttttaaccccccgtctttaccccgtttacccgggttacggggaaccccggggttaaggaacccggtaaagggtacggtaacgggtaacctaaccggaaaacggttacgttacgggtgtaccgtacgacccgttaactccttcggtttaccg

SEQ ID NO: 19695 - DNA, 663 bp, Homo sapiens
  misc_feature: GYAE6OF01C0IMM.25.86.H09.1.454.CMB.1.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccactccctccctgtctgccttcgtggttcgagacatacgtccacctatcacgttcggtcgggcttaggtcgggtcagttggctagtgtctttacgcctggtatcagcagaaaccgagggacnctacctacgctcctgattcttgatcgtcctcgtaggttaggaagtggactcctatacgtaagttcgaggcggnaggtggactcggtagggactacggtactttacgacttcccgtaccaccgtataccgacgtaccgtacgtcccgtaggccacggtccttacggaaacgttctttccgtacgtacccttaactttatttacgttacgtaacctaaacgttaagtttaacgttaccctttacccgttccttccggttacccggttaccggggaaccgggttaacggaacccggtagggtaaggaaccggtaactaaacccggtaaacgtacgttcggtacggtacctacggcctaacgttaccgg

SEQ ID NO: 19696 - DNA, 546 bp, Homo sapiens
  misc_feature: GYAE6OF01CQW5I.25.86.H09.1.454.CMB.1.raw
  modified_base (219)..(219): a, c, t, g, unknown or other
  misc_feature (219)..(219): n is a, c, g, or t
  modified_base (332)..(332): a, c, t, g, unknown or other
  misc_feature (332)..(332): n is a, c, g, or t
  modified_base (517)..(546): a, c, t, g, unknown or other
  misc_feature (517)..(546): n is a, c, g, or t
tcagactgtacagtcacgaccggtgctcgatttagtgctatagacttggggtttgggagaaagaacctactatgcagactctgtgaagggtcgattcaccacctccagagacaacatcaagaactccctgtatctgcaaatggacagtctgacacctgatgacaccgcttgtattatgtgtgaaaggcggtgttgaggtgaatgcctaggaacccccgnggtcagcactacttcacagtgggcgtcgtggggacaaagggctacggtcatcgtctcctcgacgccctacccgaccgaaggggccccctagttcccgggtccctttcccccgnggcccgcccctggccctcgagggacgcccacccgtcggagaacgctaaccgcggcccgggcccgtggggcctggaccccgttgggaccgtaaaaggcccttaacctttcccgaaccgttggtaaccctaggttcctaggacggccgggggtctacggggacctaaacgggcgacgtaagtagcannnnnnnnnnnnnnnnnnnnnnnnnnnnnn

SEQ ID NO: 19697 - DNA, 704 bp, Homo sapiens
  misc_feature: GYAE6OF01A5959.25.86.H09.1.454.CMB.1.raw
  modified_base (285)..(285): a, c, t, g, unknown or other
  misc_feature (285)..(285): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttgcgggctagtcgggtcagttggcagtgcttttagccttggtactcagcaagaaaccgaggggaanctacctaagctcctgattcgttgatcgcctcgtaggtttaggaagtggacgtaccatcgaaggttacaggcgtacgagtggattacgtagggactagtattcgaactccctacaccgtactaccgaacgtccgaacgtcccgttagacggtaaccgtacccgttaggtaaacgtttacgttacctaacggtacccttaaaccgtttaacttttaacgttacggttaaacctaaaaccgtttaaaggtttttaaaccgggttaacccttttaaccccggttccgttaaccccgtttccgggttaaccggggtaccgggtaaaccgggggtaacccgtaaaggggtttacgggaacgtaaaccggttaaccgtaaaaacggacggtttacggtcggaccgttacgtacccgccggttaacg

SEQ ID NO: 19698 - DNA, 697 bp, Homo sapiens
  misc_feature: GYAE6OF01E1BDA.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctgggcttctgctgctctggctccaggtgccaaatgtgccatccagttcgacccagtctccatcctcctgtctgcctctgtcgagacatacgtccaccatctacgttggtccgggctaggtcgggtcagttggctagtcgtacgttacgccgttggtactcgagacgaaacggaaccggaggggaacgtccgtaccgtacgtccttccgtagtacttcgttagacgtcgtccttacggttaaggtttaggaaacggtcggtaccgtacctagtacgtaacggtcgacggcggtacgtaggtacggtagtcggtacggtaactacgttacttaccacttaccctacctaacctacgtaccgacgtaccgtacgtccgtacgaccgtacgtaccgtaagtaacgttacttaccgtacgtaaccttaacttacgtttacgttaacgtaacttaaacgttaacgtttaaccgttacctttacccgttacgttacccgttccggtacgggaccgggtaacgggtaaccggtagggtacggaacgtaacgtaaccgtaaacgtacgtcggtacgactacgtacgtacgta

SEQ ID NO: 19699 - DNA, 478 bp, Homo sapiens
  misc_feature: GYAE6OF01CIMFN.25.86.H09.1.454.CMB.1.raw
  modified_base (220)..(220): a, c, t, g, unknown or other
  misc_feature (220)..(220): n is a, c, g, or t
  modified_base (351)..(351): a, c, t, g, unknown or other
  misc_feature (351)..(351): n is a, c, g, or t
  modified_base (436)..(436): a, c, t, g, unknown or other
  misc_feature (436)..(436): n is a, c, g, or t
  modified_base (462)..(478): a, c, t, g, unknown or other
  misc_feature (462)..(478): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtagaaaggcggtgttgaggtgaatgcctcggaacccccgngtcagcacttacttctacagtgggcgtcgtggggacaaagggctacggtcatcgtctcctcacgccctaccacccgaacgggcccacgttccggtcccttcccccgtggccctcccctgcctccgaggacnccacccgtcgagacgcaccgacgccggccctgggctcgccgtgacgacgtacctacctcacgtgactagtcgtacgaggccgggntacgggacgaacggcgactagtacgnnnnnnnnnnnnnnnnn

SEQ ID NO: 19700 - DNA, 613 bp, Homo sapiens
  misc_feature: GYAE6OF01EQZMM.25.86.H09.1.454.CMB.1.raw
  modified_base (282)..(282): a, c, t, g, unknown or other
  misc_feature (282)..(282): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtctattggcagtgtctttagcctggtatcagcaagaaccgaggggacnctaccagctcctagtattcgtttgatcgtcctacgtagtttaggaaaggtggacgtaccatacgaaggttcaggcggctaggtggatcgtgggacagtattcactcctcaaccctatcgacgcacgccgtgccgacgtcccgtaaggaactactttcgacgtaacctaacctttaatttacttacgtaactaacgttaaatttaacggttacctttaccctccgttacctccggtttacgggacggtaacggggtaaccgtaaggggttagaacggtataaacccgggtaaacgtacggttcggtacgggtacctacggtacctacgtacg

SEQ ID NO: 19701 - DNA, 827 bp, Homo sapiens
  misc_feature: GYAE6OF01EHHNY.25.86.H09.1.454.CMB.1.raw
  modified_base (815)..(815): a, c, t, g, unknown or other
  misc_feature (815)..(815): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggcctccaggtgaccaaatgtgccatccgagttcgacccagtcctccactccctcctgtctcgccttcgtgtcgagactatacgtccacctatcctacgttggtccgggtactacgggtcgggtctagttggctaggtcgtcttacgcctggtactacgagacgaacgaaaccggagggaactcctaccgtaacgtcctccgtagtactttcgttagactccgttaccgttacgttaggtttaacggtaacggtcggtaccgtaccgtagtacgtaggtacgacggacgtacgtagggtgtacgtacgggtacggacgtattacttactaccttcccgtaaccaaccgtacttaccgacggtaccgtaccgtaccggtcgaaccgtaccggtaaccgttagggtaaacgttcctttaccgggtaaccttaacctttaaaccgttagttttaacgttaaccgttaaaaccctttaaaacgggttttaaacgttttaaacccggtttaccccctttaaccccgtttaccggttacccggtttaccccgggggttaacgggggaaacccccggggttaaagggttaaaccccgggtaagggggttacccggaaacgtttaccgaaaaaccccgggttaaacggttcgggtttacccggggtactaacccgttccggttaaaccccncgggttttaacc

SEQ ID NO: 19702 - DNA, 465 bp, Homo sapiens
  misc_feature: GYAE6OF01BUJHI.25.86.H09.1.454.CMB.1.raw
  modified_base (444)..(444): a, c, t, g, unknown or other
  misc_feature (444)..(444): n is a, c, g, or t
  modified_base (450)..(451): a, c, t, g, unknown or other
  misc_feature (450)..(451): n is a, c, g, or t
  modified_base (453)..(465): a, c, t, g, unknown or other
  misc_feature (453)..(465): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttcacatgggcgtctgggggcaaagggactacggtcatcgtctcctcacgcctccaccgaacgggccccatccggtccttcccccgtggccgccctgcctccgacggagccacctccgagacgcaccgagccggcccgtggggcctcggcccgtcggtcgaacgggtacctaccttcccacttcgtactgtactggcgcgggtctgggcaaggcncatagnngnnnnnnnnnnnnn

SEQ ID NO: 19703 - DNA, 534 bp, Homo sapiens
  misc_feature: GYAE6OF01CO5DR.25.86.H09.1.454.CMB.1.raw
  modified_base (220)..(220): a, c, t, g, unknown or other
  misc_feature (220)..(220): n is a, c, g, or t
  modified_base (500)..(534): a, c, t, g, unknown or other
  misc_feature (500)..(534): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtagaaagggcggtgttgaggtgaatcgcctggaacccccgnggtcagccactacttctacatgggctcgtggggacaaaagggctacggtacacttcgtctcctcacgcctccaaccgaacgggccccattccggtcctttcccccgtggccgccccgtgcctccgaggacgccacctccgagacgcaccacggccggtcccgtgggctcgccgttcggtacgaacgggtacctacgttaccctacgttagtaccgtagttacgtcggaacgggtccggggtcgttacggggaccgtaaacgggcgaaccgtaagtggacnnnnnnnnnnnnnnnnnnnnnnnnnnnnnnnnnnn

SEQ ID NO: 19704 - DNA, 779 bp, Homo sapiens
  misc_feature: GYAE6OF01C0CHI.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaatgtgccatccagttgacccagtctccatcccctcctgtctcgtcctcgtgttacgagactatacgtccacctacttcctacgttcggtcgggtcgttacggtccgggtatagttcggacgtaggtcgttcgtttacgccgttaggtactacgacgacgaacgaaccggtagggaacgtcctacgtacgtctccgtagtactttcgttagacgttccgtcccgttacgttaagggtttaggtaacggtcggtacccgtaccgtacgtaaccggttaacgggttacggacggacgggtacgtagggtacgtacgtacgggtacggtacgtagttactttactaccgttacctaccacctactaccgacgacgtaccgtccgtacgtacgtaccgaccgttaaggtaccgttacgttctaccgtaacctaccgtttaagtttacgtttaacgtaacgttaaaacgtttacggttttaaacccgttaccctttaacccgttcccgttaaccggttcccgggttaacggggacccgggtaacggggtaccgttaaacggggtacggtaacgtaaaccgttaaccgtaaaccggttcggttacggttacccggacttaccgtcccgtaaccgttacg

SEQ ID NO: 19705 - DNA, 573 bp, Homo sapiens
  misc_feature: GYAE6OF01AHTCX.25.86.H09.1.454.CMB.1.raw
  modified_base (220)..(220): a, c, t, g, unknown or other
  misc_feature (220)..(220): n is a, c, g, or t
  modified_base (541)..(541): a, c, t, g, unknown or other
  misc_feature (541)..(541): n is a, c, g, or t
  modified_base (543)..(545): a, c, t, g, unknown or other
  misc_feature (543)..(545): n is a, c, g, or t
  modified_base (547)..(573): a, c, t, g, unknown or other
  misc_feature (547)..(573): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattacttgtgtgtaaaggcggtgttgaggtgaatgcctcggacccccgnggtcagcactacttctacagtgggcgtcgtggggacaaagggacttacgggtcacgttcggtctacctcgacgcccttcccaccaacggggccccacgttcccggttccttccccccgtggtcccgcccgtgaccctcccgaaggcgccacctccgagacgcacacggtccgacccgttcgggtacctcgtccgtcggtaccaaacggtaccttaccttccacgttacggtaccgtaacgttcgttcggaacgggtcccgggtaccgttgggaaccggtaaacgggtccggaccgtaaggttaacgggcctataggccagncnnnannnnnnnnnnnnnnnnnnnnnnnnnnn

SEQ ID NO: 19706 - DNA, 715 bp, Homo sapiens
  misc_feature: GYAE6OF01DHB4Q.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgtctctgttcgagacatagtcaccatcacttgtcgggctaggtcgggtcagttggcagtgtctttagcctggtatcagcaacgaaaccgaggggaagctacctaagcctcctgtacttctttgactcgcccttacctaggttttacggaaaaggttcggacgttaccccaagttaccgtaaagggtttccaacggtccgggacctaagggttcgggtaacttcggtaggggaactaaggttacttttaccgacttccccttaccaacccgtaacttaccgaacggtacctaaccggtccgttaggaccctaacgggtcccgttaaggtaaacgtactttaccgtacggtacccttaaacctttagtttaactttacggttaaacctaaaacgtttaaacgtttaacggtaccttttaaccccgttccgttccgttacccggtttacggggaccgggtaacgggaacccgtaaggggtggaaacggtactaaccgaaacgttacgtggtacggctacgcctacgtacg

SEQ ID NO: 19707 - DNA, 842 bp, Homo sapiens
  misc_feature: GYAE6OF01EPZKO.25.86.H09.1.454.CMB.1.raw
tcagactgtacagtcacgaccggtgctcgatttagtgctatagacttgggtttgggggcaggagtcagacccactcaggacacagcatggacatggagggtccccgctcagctcctggggcttctgctgctctggctccgaggtgaccaaatgtcgccatccagttcgacccagtctccactccctcctgtctcgtcccttcgtcgttcgagacatacgtccacctatcctacttcgggtcgggtcgtacggttcgggtctagttcgggactacggtcgttacgtttacggtccgttgggtaactacgaacgaccggaaacggaaaaccgggaacgggggaacgtcccgttaaccgtaaacggtcccttacccggttagtacgtttccgttttacggtacgttccggttaccccgttaccggtttaagggtttaacgggtaaaacgggtccgggtaaccgttacccgtaacgttaaccggtaaacgggtccgaacggtccgggtacgtaacgggttaggtaccggttacggtacggggtaacgtaggttacttttacccgtaccttacccgtaccctaacctacgtacaacggtaccgtaaccgtccgtacggtacgaccgggttacctaacggtaaattcccgtttacgaccgttaaccttaaactttacgtttaacgtaaccgttaaccttaaaacggttaaacttttaaccggtaaccctttacccgtctttacccgttacgggtaccggggtacgggaacggtaacccgggtaagtacggaacggtaaacgtaaccgtaaacggtccggtcggtacgtctaccggtaactccgtaccg

SEQ ID NO: 19708 - DNA, 619 bp, Homo sapiens
  misc_feature: GYAE6OF01BFGXR.25.86.H09.1.454.CMB.1.raw
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcgggctagtcgggtcattggcagtgctttagcctggtatcagcaagaaaccgaggggaagctcctaagctcctgattctttnatcgcctcagtttaggaaagtggactccatacgaaggttcaggcggcaggtggtatcggtagggagtagtatttcacttcctaccacctatnacgctacgcctgaccagtccctagaatacttcctacgaccttaaacctttatttaattaccgtaactaaacgttaaatttaacggaaccttttacccctcttaccttcccgggtttagggacccgggtaaagggtaacccggtaagggtacgggtaacgtaacgttaaacccggaaaacggtaacgttcgggtacgggtaccttacgggaccctaaccgtacg

SEQ ID NO: 19709 - DNA, 721 bp, Homo sapiens
  misc_feature: GYAE6OF01ASR9X.25.86.H09.1.454.CMB.1.raw
  modified_base (322)..(322): a, c, t, g, unknown or other
  misc_feature (322)..(322): n is a, c, g, or t
  modified_base (675)..(675): a, c, t, g, unknown or other
  misc_feature (675)..(675): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctccaggtgccaatgtgccatcccagttcgacccagtcctccatccctccctgtctcgccttcgtgttcgagacagtacgtcaccatctacgtttcggccgggtcttaggtcggggtctagtttgggcaggttacgtcttttaacggccgttggtatccgtacgcgaacgaaacggacgggggtacnccgttaccgtaacggtccttacgtagtctttccgtttaggacttcgtccgttaccgtaagggtttagggaaacggttgggaccctaccgtaacgttaacgacggtttacgacggtacggacgtaggtacgggtactcggtagggactacgttactttacaccttacctaaccacgtatcggaacgcgtcgaaccgtcgacgaccgtacgttaagtaacggtaccttcggaccttaacaaccgttttatttaacgttaacgtaacctaaaccgtttaaagtttaacggttacccttaacccggttcttccgtttacccgggtacgggacggggtaacggtaacggacgggttanaacgtacttaacggaacgtacgttcggagtactacgcgttaactcg

SEQ ID NO: 19710 - DNA, 788 bp, Homo sapiens
  misc_feature: GYAE6OF01BIQMR.25.86.H09.1.454.CMB.1.raw
tcagactgtacagtcacgaccggtgctcgatttagtgctatagacttgagctctgggaaaggagccccagccctgagattcccaggtgattccattcggtgatcagcactgaacacagaactcaccatggtagtttggactgagtcgttgggtttttccttgttgaccttaagttttaaaaggtgtccagttgtagaagtgactaacgtgggtggagtcggtgggggacgccggtggtacgacggggcccggggggtccctggacgtacctccgttccgtggttgtacgtcccttcgtaggtacttctagttggtttagtagttgttaattacgtcgacctagtcgtccgtacggttcgggtaccgtacgggtaacggggtacgggggtaaggttcggtgggtacggttcgggttccttcgttacgttagtacggtacggtttaggggagtaaggggaaacgtaaaccgtaaccgtacgtagtacgacctaacgttacgtcggttaggtacggtaacggtcctaaccgttacccaacccgtacccgttaacgaacggtaaaccgaacaaacgttaacgtaaacccgaaacgttaaccctttcccgtagttactaccgtagtaactaaggtcggaactcggtacaccgaacttacgagtacctaccgacccgttaccgttacgtttagttacttaggttcggtaaggtaagggtaacgggtttcggtagttacgggacgttagaacggtcccgtacccggtacccgggaccccggtgtaccgtaacccg

SEQ ID NO: 19711 - DNA, 837 bp, Homo sapiens
  misc_feature: GYAE6OF01BTSCR.25.86.H09.1.454.CMB.1.raw
  modified_base (449)..(449): a, c, t, g, unknown or other
  misc_feature (449)..(449): n is a, c, g, or t
tcagactgtacagtcacgaccggtgctcgatttagtgctatagacttgggtttggggagctctgggaaaggacgccccagccctgagattcccaggtgattccattcggtgatcagcactgaacacagaactcaccatggagtttggactgagtcgttgggttttccttgttgtacctaattttaaaaggtgtccagtgtgaagtgacaacgtggtggagtcggtgggggacgtccggtagggtaccgacggggtcccggggggtccctaggacgtacctctccgtggtagtacgtcctcgtggtattcgagttgtttagattgtacttagcgcctagtcgacgtacggttcgggttcccgtacggtaacggggttcccgggggaaggttccgtaggggtaggttcgggttcctcgttacgtttagtggttacgttgggagtagggaanaacgtaacctagtatcggactagtacttgtacggtaggtaacggtcgtacttacccgaacccgtacccgttacgaacgtaacggaaacctaaacgtacgtaaccgtaaaacgtaacccggtttcccttaagttaacgttccgtaacggaactaaacgttacggaaccgtacgttaccgtaacggtaacccttaaccgggttagaaccgtttaccggtaacccgtaccccggtttaaccttttaaggggttaaaccttttagggtttacggtacggggttaaagggttaaaccggggttgggtttacgggttagggtaacggttaacggttaaacggcccgggtttaaccccccggtacgggtaacccccccggggttcggttaacccg

SEQ ID NO: 19712 - DNA, 623 bp, Homo sapiens
  misc_feature: GYAE6OF01DVG63.25.86.H09.1.454.CMB.1.raw
tcagactgtacagtcacgaccggtgctcgatttagtgctatagacttgggtttgggggggagtcagacccactcaggacacagcatggacatgagggtccccgctcagctcctggggcttctgctgctctggctcccaggtgccaaatgtgccatccagttcgacccagtctccatcctcctgtctgcctctgttcgagacatagtcaccatctacttggtcgggctaggtcgggtctagttggctagtgtctttagcctggtatcagcaacgaaaccgagggaagctactaagctcctgtattcttgactcgtcctacgtaggtttaggaaagtcgacgtccctatacgtaaggttcaggtcggactaggtgatcgtagggactagtatttcactcctacacactcacgctacgtccctgaccgacgtccgtagtaacgtacttcgtacgtacctaacttatttaattacgtaactaaacgttaaacgttttaacggtacctttaacccgttcttaccgtttaccggttaccggggtaacgggtaacgggtaaccgtaagggtacggtaacgtaacgtaacgaaacgtacgtgtacggtctacgacctactacgttcgtacg

SEQ ID NO: 19713 - DNA, 455 bp, Homo sapiens
  misc_feature: GYAE6OF01DBQHF.25.86.H09.1.454.CMB.1.raw
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (440)..(455): a, c, t, g, unknown or other
  misc_feature (440)..(455): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgcttgtattattgtgtagaaggcggtgttgaggtgaatcgcctcggaacccccgcggtcagctactacttctacagtgggcgtcgtggggcaaagggactacgtcatcgtctcctcacgcctaccacgaacggcccagggtccgtccttcccccgtggccgcccctgcctccgaggacnccacccgtccgaganccacaggccggccgtgggctcgccgtgacgaaggtacctactcacttgactgtcnggnggcggtcgngacaaggcagnacgnnnnnnnnnnnnnnnn

SEQ ID NO: 19714 - DNA, 547 bp, Homo sapiens
  misc_feature: GYAE6OF01ANVQO.25.86.H09.1.454.CMB.1.raw
  modified_base (280)..(280): a, c, t, g, unknown or other
  misc_feature (280)..(280): n is a, c, g, or t
  modified_base (411)..(411): a, c, t, g, unknown or other
  misc_feature (411)..(411): n is a, c, g, or t
tcagactgtacagtcacgaccggtgctcgatttagtgctatagacttgggtttggggggcaggagtcagacccactcaggacacagcatggacatgagggtccccgctcagctcctgggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaanctcctaagctcctgatctttgatgcctcagtttggaagtggagtccatcaaggttcagcggcagtggatcgtgggacaggtactttcgactcctacgaccatcagcaacgcctgacaggcctaggaacgtnttctcgactaacccttatttattcgtactaaacttaagtttaacggactttaccctcttcctccgttcgggacgggtacgggaccgaagggtggacgtacgtaccgaaacgacgttcggtcggactcgccactacg

SEQ ID NO: 19715 - DNA, 526 bp, Homo sapiens
  misc_feature: GYAE6OF01CLH8K.25.86.H09.1.454.CMB.1.raw
  modified_base (364)..(364): a, c, t, g, unknown or other
  misc_feature (364)..(364): n is a, c, g, or t
  modified_base (497)..(526): a, c, t, g, unknown or other
  misc_feature (497)..(526): n is a, c, g, or t
tcagactgtacagtcacgaccggtgctcgatttagtgctatagacttgggtttgggagaagaacctactatgcagactctgtgaagggtcgattcacccacctccagagacaacatcaaagaactccctgtatctgcaaatggacagtctgacacctgatgacaccgccttgtattattgtgtgaaaggcggtgttgaggtgaatgcctcggaacccccgcggtcagcactacttcctacagtgggcgtcgtggggacgaaagggctacggtcatccgtctcctcacgccctaccaccgaacgggcccctacgttccgggttccccttcccccgtcgggcccgcccctcgccctccgagggacncccaccgtccgagacgcacgacggccggcccgtggggcctcggccctcgggtactaacgggaccttaccttcccaccgtacgtacacggttcctagggcggcggggcgtgggaccgaagggccgacagtacgnnnnnnnnnnnnnnnnnnnnnnnnnnnnnn

SEQ ID NO: 19716 - DNA, 737 bp, Homo sapiens
  misc_feature: GYAE6OF01BORM7.25.86.H09.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctccgaggtcgaccaaatggtcnccatccagttcgacccatcctccactccctcctgtctgcctntgtcgagacatatcacctatcagttggcggactaggtccgggtnagttggctagtcgtactttacgccgtggtaatcaacggactaacggaaaaccggagggggaactaccttaaccgtaaggccttccgtagtattcgtttacggaatccgtacccgttacgtaagggtttaacgggaaagttcgggaacctcccgtaaataccggtaaaggttccgaagggtcgacgttaagggcggtaactttcggtaacggggaacagggtttaactttaccaacgttaccccttacgaaacctacttacgacgtaacgaccggtacgtcgtacgaccgtacgtaagtaaacgtacttaccgtacgtaacctaaactttaacgttaacgttactaacgtaaacttaaacggttaaaccggttaccttaccctaccgttacgtaccggttacgggacggtaacggggtaaccgtagggtaggtaacgtaaacgtacgtaaaacgtccgtttagggaccgggtacttacggccgtaacgttaccg

SEQ ID NO: 19717 - DNA, 729 bp, Homo sapiens
  misc_feature: GYAE6OF01D2JJ5.25.86.H09.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (722)..(722): a, c, t, g, unknown or other
  misc_feature (722)..(722): n is a, c, g, or t
tcagactgtacagtcacgaccggtgctcgatttagtgctatagactttggggtttggggagctcgtagggaaaggacgccccagccctgagacttcccgaggtgacttccagttcggtgatcagcactagaacacagaactcactagtggtagtttggactgacgtcgtttggtttccttgttcgtaccttaaagtttaaaaggtcgtacgtagtgtagaagtgacagtggtggacgtcggtggggcncggtaggacgcggggccgggggtccagacgtctctcgtagtcgtacgcctgtagtnttanagtttgttagatcgtattagcgactagcacgtaacggtcggggtacctaacgggtacgggtaccggggagtcgtagggtggttcggtctaccgttagttagtaggacgggttggaaggtacggaaagaaacgtccttaatacggcgtaagttagccgtttaggaggtaaggtacgtactcttaacccaccgtaccgtaacgaacgaaccgaactaaacaaccgaagtaaccgtaacgtaccctaagtacgtaccgtaagaaacgtaacggcgtaactacgtaccgtaacgaccgttaccagtaacctaggtaacctacccgttagtagtttaaccgttagaacggttaggtaaggtaacggtcgttaaggtacggtaggaacgtacgtacccggtaaccgacccggtaccccgngtacccg

SEQ ID NO: 19718 - DNA, 507 bp, Homo sapiens
  misc_feature: GYAE6OF01D2RVB.25.86.H09.1.454.CMB.1.raw
  modified_base (489)..(507): a, c, t, g, unknown or other
  misc_feature (489)..(507): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgcttgtattattgtgtagaaaggcggtgttgaggtgaatgcctggaacccctgcggtcagcactacttctacagtgggcgtcgtggggacaaaggggactacggtcatccgtctcctcagccctccaccgaacgggccccagtccggtccttcccccgtggcccgccctgcctccgaggacgccaccctccggagagccacacggccggcccgtggggcctcggccgtcgggtaccgaaagggtaccttaccgttcccaacgttacgtactaggttccgtggacgggtcggggccgtggggaccgaaggggtccgactaagtagnnnnnnnnnnnnnnnnnnn

SEQ ID NO: 19719 - DNA, 742 bp, Homo sapiens
  misc_feature: GYAE6OF01CUAXU.25.86.H09.1.454.CMB.1.raw
  modified_base (458)..(458): a, c, t, g, unknown or other
  misc_feature (458)..(458): n is a, c, g, or t
  modified_base (565)..(565): a, c, t, g, unknown or other
  misc_feature (565)..(565): n is a, c, g, or t
  modified_base (601)..(601): a, c, t, g, unknown or other
  misc_feature (601)..(601): n is a, c, g, or t
tcagactgtacagtcacgaccggtgctcgatttagtgctatagacttgggtttggggggacacctggggacactgaactggtgctgagttactgagatgacgccagccctgcagcttgtcgccacgccctgcccattccctctgtctactagtttcgactaattaaccgttacccaacgtaaaccacctaaccctcctcgacccgtagaacgttactttcgttaaggtacggtcgttcggtacctaccttaccgttttcgtcgacgtaacggtacgtaccaaccgtacccaaacgttcggaaacggacctaacgacggtacaaggttacggaaccgtaggttacccggggtacccggccccctgttacgaaccggttccgtccggttcgggttcctacggtcgtcgtacgtccttacggtccgtaccgtaccgacgggtacaacgttaacgtcgaccncctacgtaccgtaccgtaccgaccgtctcctaacctcgttcccttacgtcgttcgctctttcgtacgtacgacgtactctaccgaccaatcgtacgtcgtcggcgtntcggtctatggttcacgtgttcgtacgtcgtacgtntacgtaccgaagtaacccggaaagaaccgggagaccttcctaacgtcgtccgttacgagttcgttcgtggtacccttacggtaccgttgttttaacgggtaacggaaccccgttggaacccgtactaggttaacggtacgg

SEQ ID NO: 19720 - DNA, 716 bp, Homo sapiens
  misc_feature: GYAE6OF01DSGY8.25.86.H09.1.454.CMB.1.raw
tcagactgtacagtcacgaccggtgctcgatttagtgctatagacttggggtttgggggcaggagtcagacccactcaggacacagcatggacatgagggtccccgctcagctcctggggcttctgctgctctggcctcccaggtcgaccaaatgtcgccatccagttcgacccagtcctccatccctcctgtcctgtcctctgttcgagacatacgtccacatctacgttcggtccgggtcgtaggtccgggtactagttcggacgtaggttcgtacgtttacgccgttaggtactacgacgacgaaacggaaaccggaaggggaacgtaccgtaccgtaacgtccgtttacctaggtactttcgttttagacgtaccgtacccgttacgtaagggtttacggaaaggtcggtacgtacctagtacgtaacggttcacggtcgacgaggtggtactcgtcgggaatgttacttacacgtccgtacacctacgtacgtacgactacgtccgtagactacgtaccgtaagaacgtttctacgtacgtacgttaaacctttagttaacttacgttaaacctaaacgtttaagttaaaccgttcctttaacccgtactttaccgttaccggtacgggaccgggtaaaggtaccgtaacgggttagaacggtaacgaaccgtaaacgtcgtacgttcggaaccgtctaaccgtccgtacg

SEQ ID NO: 19721 - DNA, 653 bp, Homo sapiens
  misc_feature: GYAE6OF01BQQAU.25.86.H09.1.454.CMB.1.raw
  modified_base (634)..(634): a, c, t, g, unknown or other
  misc_feature (634)..(634): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgtctttagcctggtatcagcaagaaaccgaggggaagcctaccgtaagccttacctgtacttctttgatcgcctacgtaggtttagggaaagtgggacgtccctagtacgtaaggttcacggcggcgtaggtggaactcggtagggacctaggtactttcgacttacctccaacctatccgaagtccacgtcctagaccgtagtccgtaaggaacttacttcgtacctaactaaacctttattaagttaccttaacgaaactttaaacgttttaaacggtaccctttaacccttccgttcccgttacccggttcgggacccggggtaaaggtaaccggtaggggtagaacgtaccgttaaacggaaaaccgtacgttcggtaccggtntaccgacctacgttaaccg

SEQ ID NO: 19722 - DNA, 611 bp, Homo sapiens
  misc_feature: GYAE6OF01AU1BR.25.86.H09.1.454.CMB.1.raw
  modified_base (584)..(611): a, c, t, g, unknown or other
  misc_feature (584)..(611): n is a, c, g, or t
tcagactgtacagtcacgaccggtgctcgatttagtgctatagacttgggttgggagaagaaccctactatgcagactctgtgaagggtcgattcaccacctccagagacaacatacaaagaacctccctgtatctgacaaatggacagtctgacacctgatgaccaccgtccttgtattagttggtgtaggaaagggtcggtgttgaggtgaatcgccgtccggaaccccgcggtcacgccacttacttctacgagtcgggcggtcggtacgggggaacgaaacgggtacgtaccggtctacgttccgtcctcctccgaccgcccctacccgaccggaaccgggtcccctacggttcccggttccccttccccgtcggcccgtccctcgccgtccgacggccgacccacccgtaccgacgaccgaccaccggccggcccggtcccggtcgggaccctccggtacccggtacgggtaacccggaaccgttaacccgttacccttacccgacgttacggaccggtacggcgggttacgggaccgggtcgggtcgtaccggggaacggacgggcctacgtagacgnnnnnnnnnnnnnnnnnnnnnnnnnnnn

SEQ ID NO: 19723 - DNA, 516 bp, Homo sapiens
  misc_feature: GYAE6OF01DE9OF.25.86.H09.1.454.CMB.1.raw
  modified_base (198)..(198): a, c, t, g, unknown or other
  misc_feature (198)..(198): n is a, c, g, or t
  modified_base (490)..(516): a, c, t, g, unknown or other
  misc_feature (490)..(516): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattatgtgtgaaaggcgtattgaggtnaatgcctcggaaccccgcggtcagcactacttctacagtgggcgtcgtggggacaaagggacctacggtcatcgtctcctcacgccctccaccgaacggcccctacgtccggttccttcccccgtggccgtccctggcctccgaggacgccaaccctccggacgagaccgacgacggcccggtcccgttggggccgtcggtcccgtgggtaccgaacggtacccttacgttccctacgtcgtacagttctaggacggtccgggcgtcgggccgtaagggccacgtactagcnnnnnnnnnnnnnnnnnnnnnnnnnnn

SEQ ID NO: 19724 - DNA, 526 bp, Homo sapiens
  misc_feature: GYAE6OF01CX7SX.25.86.H09.1.454.CMB.1.raw
  modified_base (271)..(271): a, c, t, g, unknown or other
  misc_feature (271)..(271): n is a, c, g, or t
  modified_base (495)..(495): a, c, t, g, unknown or other
  misc_feature (495)..(495): n is a, c, g, or t
  modified_base (498)..(526): a, c, t, g, unknown or other
  misc_feature (498)..(526): n is a, c, g, or t
tcagactgtacagtcacgaccggtgctcgatttagtgctatagacttgggtttgggagaagaacctactatgcagactctgtgaagggtcgattcaccacctccagagacaacatcaaagaactccctgtatctgcaaatggacagtctgacacctgatgacaccgccttgtattattgtgtgaaaggcggtgttgaggtgaatgccctggaacccccgcggtcagcactacttctacagtgggcgtcgtggggacaaagggactacggtnatcgtcctccgtcagtccctccaaccgaacgggcccctacgtccggtccctttccccccgtggccgcccctcggcctaccgaggtaccgccaacccgtcgaacgacgaccaacgcgtccgggcccgtgggcctcgcgtcggacgaacggacccttacttccaacgtgtactagtcgtaggacggccgggtcgtacgggacgaaacgggcgtaacctaggtacgnatnnnnnnnnnnnnnnnnnnnnnnnnnnnnn

SEQ ID NO: 19725 - DNA, 513 bp, Homo sapiens
  misc_feature: GYAE6OF01CJ19I.25.86.H09.1.454.CMB.1.raw
  modified_base (360)..(360): a, c, t, g, unknown or other
  misc_feature (360)..(360): n is a, c, g, or t
  modified_base (484)..(513): a, c, t, g, unknown or other
  misc_feature (484)..(513): n is a, c, g, or t
tcagactgtacagtcacgaccggtgctcgatttagtgctatagactttgggtttgggagaagaacctactatgcagactctgtgaagggtcgattcaccacctccagagacaacatcaagaacctccctgtatctgcaaatggacagtctgacacctgatgacaccgcttgtattattgtgtagaaaggcggtgttggaggtgaagtcgcctacggaacccccgcggtcagcactacttacacagtgggcgtcgtggggacgaaaggactacggtcactcgtctcctcagccctaccaaccgaacggccccagtccgtccttccccgtgccgccctggctcgagacgccaccgtccgagngccacgacgccgggccctggggacctcggtccgttaggtcgaaacggtccttacgttacccattacgtaacagttcctaggggacggcgggtcgtacgggaaccgaacgggtcaacattagcgnnnnnnnnnnnnnnnnnnnnnnnnnnnnnn

SEQ ID NO: 19726 - DNA, 690 bp, Homo sapiens
  misc_feature: GYAE6OF01B9S0M.25.86.H09.1.454.CMB.1.raw
tcagactgtacagtcacgaccggtgctcgatttagtgctatagacttgggtttggggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccaccatctacgttggtcgggcgtaggtcgggtcagttggcaggtgtctttagccgtggtatcagacgaacgtaaaccggaggggaacgcctaccgtaacgtccttccgtagtacgttcgtttgactcgtcccttacgtaaggtttaggaaaggtcggacgtaccagttacgtaaggttcgacggcgggtacgtaggtggtatcggtaggactagttacttcacttacctacactactcacgccacgtcctgccgtaacgtccgttaaggaacgttactttaccgtacggtaaccttaaccgtttaagtttaacttaacggttaaccttaaaacgtttaaacgtttaaccggttaaccctttaaccccttccgttaccttcccgggttaccgggaacgggtaaccgggtaaccgtaagggtacggtaacgtaacgtaacggaacgtacggtcggtaccgacggtacgccgtaacccgtacg

SEQ ID NO: 19727 - DNA, 500 bp, Homo sapiens
  misc_feature: GYAE6OF01CBSDH.25.86.H09.1.454.CMB.1.raw
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (482)..(500): a, c, t, g, unknown or other
  misc_feature (482)..(500): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgcaaatggacagtctgacacctgatgacaccgccttgtattattgtgtgaaaggcggtgttgaggtgaatgccgtcggaacccccgcggtcagcactacttctacagtgggcgtcgtggggacgaaagggacgtacggtcacgtcgtctcctcacgccctacccaccgaacggccctacgtcccggtcccttcccccgtcggcccgccctcgcctccgacggacncccaccgtccgagacnccgacgacggccggccgtgggcctcgcgtcggacgaacgtacttacctcacgtcgtactacgttcngggacgggccgggtctagggacgtaacggccagtaagtcgnnnnnnnnnnnnnnnnnnn

SEQ ID NO: 19728 - DNA, 692 bp, Homo sapiens
  misc_feature: GYAE6OF01ADSS9.25.86.H09.1.454.CMB.1.raw
  modified_base (244)..(244): a, c, t, g, unknown or other
  misc_feature (244)..(244): n is a, c, g, or t
  modified_base (309)..(309): a, c, t, g, unknown or other
  misc_feature (309)..(309): n is a, c, g, or t
tcagactgtacagtcacgaccggtgctcgatttagtgctatagacttgggtttgggggcaggagtcagacccactcaggacacagcatggacatgagggtcccccgctcagctcctggggcttctgctgctctggctccaggtgccaaatgtgccatccagttgacccagtctccatccctccctgtctgccctctgttcgagacatacgtcaccatctacgttggtcgggctaggttcgggtntagttggctaggttcgtcgttttacggccgttggtactcgagtacgaaggaaaccgaggggtacnccgttaccgtaagccttcgtgtagttctttgatcggtcccttacgtaggtttaggaacggtgtaccgtacctaacgtcgtaaggttcgtaacgggccggtaagtagggttacgggtacgttcggtacgggaacgtaggttacttttacgaccttccccgtaacacttaactcggaacgtccgtaacgtcctaggcccaggtcctagaacgttcttacgtcgtaacccttaacttaatttacgttaacgtaccgtaaatttaagggttaaccttaccttaaccccgttccttccggttaccgtccgggacgggttaaccgacgggtaggttacgaacttacgaaacgtaaccggtgtcggtagtaccctcggccctaattacgg

SEQ ID NO: 19729 - DNA, 510 bp, Homo sapiens
  misc_feature: GYAE6OF01BERS9.25.86.H09.1.454.CMB.1.raw
  modified_base (476)..(510): a, c, t, g, unknown or other
  misc_feature (476)..(510): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgcggtcagcactacttctacagtgggcgtcgtggggacaaagggacttacggtcatcgtctccgtcacgccctaccaccgaacggccccactccggtccttccccctggccgcccctgacctcccgaggcgccacccgtcgacgacgccacgacggccggcccgtcgggctcgccgtggtaccaacgggtacctacgttcccacgtacgtactgtacgtggaaggtccgggagtggaacgaacgggcgacaagtgacgnnnnnnnnnnnnnnnnnnnnnnnnnnnnnnnnnnn

SEQ ID NO: 19730 - DNA, 765 bp, Homo sapiens
  misc_feature: GYAE6OF01DZ6XC.25.86.H09.1.454.CMB.1.raw
  modified_base (700)..(700): a, c, t, g, unknown or other
  misc_feature (700)..(700): n is a, c, g, or t
tcagactgtacagtcacgaccggtgctcgatttagtgctatagacttgagctctgggaaaggagccccagccctgagattcccaggtgattccattcggtgatcagcactagaacacagaactcacagtggtagttggactgagtcgttgggttttccttgttcgaccttaagttttaaaaggtcgttcctaggtgtaggtaagtgacgtaacgtggtgggtagttcgggtgggggacgtccggtgggtaccggacggggtcccggggggtcctgacgtaccttcgtcgtgtgtacgtctcgtgtattctagttgttgattgtattatgctagtcgtaccgtacggttcgggtaccgtacggtaacgggggtaccggggaggttcggtgggtacggttcgggttcctttcgttacgtttagtcggtacggttaggaagggtaagggaaacgtaaacgtaacccgttatacgtacgtacgaagttccgtggttagggtacgggtaacggtcgtaaccttacccgaacccgtacccgtaccgaaagaacgtaacctaaaccgtaacgtaaacccgtaaccgttaaacctttccccgtaaggtttaacctaccgtaagtaacctaaggtaccggaaattccggtactaccgtaacctacgttacgagtaccgtccctaccgttcgtttattagtttgtacggngttaaggtagggttgttaggtacggagttagcgttccgacccggacccgtcccggtgtacgtacc

SEQ ID NO: 19731 - DNA, 554 bp, Homo sapiens
  misc_feature: GYAE6OF01BRZH9.25.86.H09.1.454.CMB.1.raw
  modified_base (463)..(463): a, c, t, g, unknown or other
  misc_feature (463)..(463): n is a, c, g, or t
  modified_base (520)..(522): a, c, t, g, unknown or other
  misc_feature (520)..(522): n is a, c, g, or t
  modified_base (524)..(554): a, c, t, g, unknown or other
  misc_feature (524)..(554): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgcggtcagcactacttctacatgggcgtcgtgggggacaaagggactacggtcatcgtctcctcacgccctccaccgaacggggccccacgttccggtcctttccccccgtgggcccgtcccccgtcgccctcccgagggaccgccaacccgtcccggaagacggtaccaccgacggcccgggcccgtcggggcctcggcccgttacgggtcgaacgggtacctacgtttaccccacgttcgtacncgttcgtgggacggccggggtacgtcgggaccgaacgggcgacgtaacgtaggctgnnngnnnnnnnnnnnnnnnnnnnnnnnnnnnnnnn

SEQ ID NO: 19732 - DNA, 667 bp, Homo sapiens
  misc_feature: GYAE6OF01CNJ0B.25.86.H09.1.454.CMB.1.raw
  modified_base (144)..(144): a, c, t, g, unknown or other
  misc_feature (144)..(144): n is a, c, g, or t
  modified_base (227)..(227): a, c, t, g, unknown or other
  misc_feature (227)..(227): n is a, c, g, or t
  modified_base (349)..(349): a, c, t, g, unknown or other
  misc_feature (349)..(349): n is a, c, g, or t
  modified_base (643)..(643): a, c, t, g, unknown or other
  misc_feature (643)..(643): n is a, c, g, or t
tcagactgtacagtcacgaccggtgctcgatttagtgctatagacttggggtttgggggggagtcagacccactcaggacacagcatggacatgagggtccccgctcaggctccgtggggcttctgctgctcgtggcctcccgnggtcgaccaaatcgtgccatccagttcgacccagtcctccactccctccctgtctcgcctctcgtcgagacagtactcaactntcctagttcggtcgggtctacggtccgggtctagttggactaggtcgttaccgttacgtccgtggtactacgacgacgaaacggaaacgaggggaactccttacgtaacgtcctacgtagtnttcgtttagacgtcctccgtacgttaaggtttacgggtaaacgtccgggtaacctaccgtagttacgtacggccgaaggtcggacgtaggcgtagtcggtagatagtactttacactctaccgatacgtcgaccgtcacggtcccagacctaacgagtacgtaacgttacttccgaacgttaactaaccgtatttaagtacgtaataaaccgttaacggtaacttcccttaccttctcggttaccgtggggaccgttaggaccaggacgtaactagtacggaaacgcgtggtcnccgactacgaacctgttccgtacg

SEQ ID NO: 19733 - DNA, 514 bp, Homo sapiens
  misc_feature: GYAE6OF01EJGCM.25.86.H09.1.454.CMB.1.raw
  modified_base (350)..(350): a, c, t, g, unknown or other
  misc_feature (350)..(350): n is a, c, g, or t
  modified_base (481)..(514): a, c, t, g, unknown or other
  misc_feature (481)..(514): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatcgcctcggaacccccgcggtcagcactacttctacatgggcgtcgtggggacgaaagggactacggtcatcgtctcctcacgccctccaccgaacgggccccacgtccggtccttcccccgtggccgtccccgtgcctccgaggacnccaccctcccggagcgacaccgacggccggcccgtggggcctgcccgtggtacgaaacggtacctaccttccaacttcgtacgtacgtctggacggcggggtacgtgggacgaacgggccgactagtacgnnnnnnnnnnnnnnnnnnnnnnnnnnnnnnnnnn

SEQ ID NO: 19734 - DNA, 464 bp, Homo sapiens
  misc_feature: GYAE6OF01BRAES.25.86.H09.1.454.CMB.1.raw
  modified_base (218)..(218): a, c, t, g, unknown or other
  misc_feature (218)..(218): n is a, c, g, or t
  modified_base (440)..(464): a, c, t, g, unknown or other
  misc_feature (440)..(464): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacagtgggcgtcgtgggggcaaagggctacggtcatcgtctcctcagcctccaccaagggccccatccggtccttccccctggccgccctgcctccaggacgcacctccgagacgcacgagccggccctggggcctggcctggtcaaggcctacttccatcgtacatcgtagaggccgggtctgggacccaagggcgacagtagcnnnnnnnnnnnnnnnnnnnnnnnnn

SEQ ID NO: 19735 - DNA, 673 bp, Homo sapiens
  misc_feature: GYAE6OF01C91DI.25.86.H09.1.454.CMB.1.raw
  modified_base (180)..(180): a, c, t, g, unknown or other
  misc_feature (180)..(180): n is a, c, g, or t
  modified_base (657)..(657): a, c, t, g, unknown or other
  misc_feature (657)..(657): n is a, c, g, or t
tcagactgtacagtcacgaccggtgctcgatttagtgctatagacttgggtttgggggcaggagtcagacccactcaggacacagcatggacatgagggtccccgctcagcctcctggggcttctgctgctctcggctcccaggtgacctaaatgtgccatcctagttcgacccagtccnccatccctcctgtctcgcctcgtgtcgacgactatacgtaccacctatctacgttggtcgggtctacggtcggtcgtacgttggctaggtgtcgtttacggccttaggtatcgacgacgaagaaaccggagggtacgctacctaagcctacgtagtacttcgttacgtacgtcgtacccgtttacggttaggttaggtaaaaccggtcggacgtaccctagtaaccgtaagggttccgaggacggtccgagggttgaacgtcggttacgggactaagttacttcgtaccttcccgtaccaactcgtacacgacgacgtacctacgacgtacgtcctaggtaactcgtactacgtacctaactagtttactacgtaataaacgttattacgtaccttacctccgttacgtaccgtcggaccggtaaggtaccggtaagggaggtaactcgttaaccgaaacgttcgtcggtacgttanaccgttccaagttccg

SEQ ID NO: 19736 - DNA, 518 bp, Homo sapiens
  misc_feature: GYAE6OF01BTG10.25.86.H09.1.454.CMB.1.raw
  modified_base (221)..(221): a, c, t, g, unknown or other
  misc_feature (221)..(221): n is a, c, g, or t
  modified_base (487)..(518): a, c, t, g, unknown or other
  misc_feature (487)..(518): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatcgcctcggaaccccccgnggtcagccacttacttctacatcggggcgtcgtggggacaaagggactacggtcatcgtctcctcagcctccaccaagggccccatcggtccttccccctggccgcctgctccaggacgcacctccgagacgccacacgccggcccgtggggcctacggccgttacgggtaccgaacgggtaccttaccgttccaaccgtgttaaccgaggttccttagggacggccggggtcctggggacccgtaaggccggtacagtagctagnnnnnnnnnnnnnnnnnnnnnnnnnnnnnnnn

SEQ ID NO: 19737 - DNA, 670 bp, Homo sapiens
  misc_feature: GYAE6OF01EPKDP.25.86.H09.1.454.CMB.1.raw
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
  modified_base (564)..(564): a, c, t, g, unknown or other
  misc_feature (564)..(564): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaacgtggtggagtcgtgggggagccgtggtacgacgggccggggggtccctggacgtactcctccgtgtgtacgcctcgtggtattcgagttggtttgatgtattatcgcctagtcgctacggttcgggtaccgtacggaacggggtccgggggaaggtcgtgggtaggttcgggtcctcgttacgttagtggtacgttaggggacgtaggggaaacgaacgtaaacccgtagtaatgacacgtactcgtaggtaggtaacgggtctacgttaccaaccctacctccgaagacgaacaanactaacaaacgtaactcccgtagttacnctagaactaagtcggtacacggtacacgtaaccacgtgtaacncgtaccgaccgttcttaacgtagttagttcggtagtagggtaacgggtggtttacggtggtaacggtatacggtaccgccgtacccgggaccccgtgtacgtaccg

SEQ ID NO: 19738 - DNA, 653 bp, Homo sapiens
  misc_feature: GYAE6OF01BHJNL.25.86.H09.1.454.CMB.1.raw
  modified_base (282)..(282): a, c, t, g, unknown or other
  misc_feature (282)..(282): n is a, c, g, or t
tcagactgtacagtcacgaccggtgctcgatttagtgctatagacttgggtttgggggcaggagtcagacccattcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagcaagaaaccgaggggaanctacctaagctcctgactcttgatcgcctcctagtttggaaagtggacgtccatacgaaggttcagcggcgaggtggtatcgtgggactagtactttcagttccctacacctatccaacggtccaacgtcccttagacctaacggtcccgttagaaaccgttatttccgtacgtacccttaaaccctttagtttaacgtttacgtaactaaaccgtttaaaagttttaacggttaacctttaaccccgtccgttaccgttccccggtttacggggaccgggtaaccggggtaacccgtaaaggggttacggaaagtaccgtaacggaaaacgttaaccgttcgggtacgacccgtagacccgtaccgtacg

SEQ ID NO: 19739 - DNA, 584 bp, Homo sapiens
  misc_feature: GYAE6OF01ERO7Z.25.86.H09.1.454.CMB.1.raw
  modified_base (361)..(361): a, c, t, g, unknown or other
  misc_feature (361)..(361): n is a, c, g, or t
tcagactgtacagtcacgaccggtgctcgatttagtgctatagacttgggtttggggggcaggagtcagacccactcaggacacagcatggacatgagggtcccccgctcagctcctgggggcttctgctgctctggctcccaggtgccaaatgtgccatccagttgacccagtctccatccctccctgtctgcctctgttcgagacatagtcaccatcacttgtcgggctaggtcgggtcattggcagtgctttagcctggtatcagcaagaaaccaggggaagctacctaagctcctgcttctttgatcgcctcgtaggtttaggaaaggtggacgtaccatcgtaaggttcaggcggnaggtgatcgtagggactagtatttacacttcctacaaccatcagtcagtcctggccacgcctagtaacgtacttcgagtaccctaaactttattacttagtaactaaacttaagttttaacgtactttacccctcttccgttaccgtccgggtacgggaacgggaccgtaaggggtcgaagtacgtaacgaaaccgtagtcggcggactcggactaccgtacg

SEQ ID NO: 19740 - DNA, 504 bp, Homo sapiens
  misc_feature: GYAE6OF01B5JXV.25.86.H09.1.454.CMB.1.raw
  modified_base (218)..(218): a, c, t, g, unknown or other
  misc_feature (218)..(218): n is a, c, g, or t
  modified_base (345)..(345): a, c, t, g, unknown or other
  misc_feature (345)..(345): n is a, c, g, or t
  modified_base (480)..(480): a, c, t, g, unknown or other
  misc_feature (480)..(480): n is a, c, g, or t
  modified_base (482)..(504): a, c, t, g, unknown or other
  misc_feature (482)..(504): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtccagcactacttctacagtgggcgtcgtggggacaaaggggctacggtcatcgtctcctcacgccctccaccgaacgggccccatccggtccttcccccgtggccgccctgcctccgaggtacnccacctccgagacgcacgacgccggccctggggctacggcccgttaggtacgaacggtaccttaccgttacccacgttacgtaccgtagtccgttagacgggtccgggtcgtgggaccgaacgggcgctaaaggngnnnnnnnnnnnnnnnnnnnnnnn

SEQ ID NO: 19741 - DNA, 520 bp, Homo sapiens
  misc_feature: GYAE6OF01BM6E2.25.86.H09.1.454.CMB.1.raw
  modified_base (196)..(196): a, c, t, g, unknown or other
  misc_feature (196)..(196): n is a, c, g, or t
  modified_base (485)..(485): a, c, t, g, unknown or other
  misc_feature (485)..(485): n is a, c, g, or t
  modified_base (489)..(520): a, c, t, g, unknown or other
  misc_feature (489)..(520): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgnggtgaatgcctcggaaccccccgcggtcagcactacttctacagtgggcgtcgtgggggacgaaagggactacgggtcatccgtcctcctcgacgccctccacccgaacgggccccagtccggtcccttcccccgtggcccgcccctcgccctccgaggtacgccacccgtccgagacgaccacgacgccgggaccctggggtcctcgccgtcggtccgaagtacctaccgttccacgtcgtactagtccgaggacgggccgggcgtacggacgacggtcgatagacgnagcnnnnnnnnnnnnnnnnnnnnnnnnnnnnnnnn

SEQ ID NO: 19742 - DNA, 713 bp, Homo sapiens
  misc_feature: GYAE6OF01CIW4X.25.86.H09.1.454.CMB.1.raw
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctcctgtctgcctctgtcgagacatagtcacatcacttgtcggctacgtcgggtctagttggcagtgtctttagcctggtatcancgaagaaaccgagggacgctacctaagctctagtnttcgttanatcgcctacgtagttacggaaagtcggtactaccagtacctaaggttccgaaggccggagtacggtggacgtcgtagggtactagttacgtttactaaccgttccctaacctacctacgtaccgtacgaccgtaaccggtccttaccggaacgtaacccggtaccggttaacgtaacggttaccttaccgttacgaacctttaacctttaagttttacgttaacctaaacgttaaacgtttaacgttaaacgtttaccctttaaccccgttaccgtttacggttacccgggttaccggggtaaccgggaaacgggttaaaccggtaggttaacgggttaacgaaccgttaaacggaaacccggttaagttcggttacgtacctacggtacccaaccttagttctttaccg

SEQ ID NO: 19743 - DNA, 803 bp, Homo sapiens
  misc_feature: GYAE6OF01ERO0P.25.86.H09.1.454.CMB.1.raw
tcagactgtacagtcacgaccggtgctcgatttagtgctatagacttgggtttgggggcaggagtcacgacccactcaggacacagcatggacatcgagggtcccgctcacgtctccgtggggcttcgtgctcgctcgtggcctcccaggttgaccgaaatgtcgccactccgagttcgaccctacgtctccactcctccctgtctcgtccttgtggtcgagactagtacgtccgacctagtcctacgttggtcgggacgttacggtccgggtctaaggttcggtccgtaggtcgtaccgtttacgcccgtaggttactacgtaacgacgtaaacggtaaaccggtacggggtaactccgtaccgtaacgtccgtaccgtcgtacgttcgttacggtcgtcgtccgtacgtaggttagggtaacggtcggtaccgtaccgtagtacgtaggtcgacggtcggtacgtacgggtcggtacgtacgggtacgggttaactacggttacgttaccgtaccgttaccctaccgtaacccgtaacgtacccggtaaacgcgtaaccggtcccgttacgaaccgtaacggtacgttaacggtaacgttacgttaccgtacgtaacccgttaactttaacgttacgttacttaaacgtaaccgtttaagtttaaccggacctttaaccccgtcgttaccgttccggtacgggtaccggtaacggtacgggtaacgggtacggtaacgtaaccgggtaaacgaaacgggtacgtcgggtacgtaaccgtacggtaacccgtacgttaccgg

SEQ ID NO: 19744 - DNA, 582 bp, Homo sapiens
  misc_feature: GYAE6OF01EZX5F.25.86.H09.1.454.CMB.1.raw
  modified_base (228)..(228): a, c, t, g, unknown or other
  misc_feature (228)..(228): n is a, c, g, or t
  modified_base (540)..(542): a, c, t, g, unknown or other
  misc_feature (540)..(542): n is a, c, g, or t
  modified_base (544)..(545): a, c, t, g, unknown or other
  misc_feature (544)..(545): n is a, c, g, or t
  modified_base (549)..(551): a, c, t, g, unknown or other
  misc_feature (549)..(551): n is a, c, g, or t
  modified_base (553)..(555): a, c, t, g, unknown or other
  misc_feature (553)..(555): n is a, c, g, or t
  modified_base (557)..(560): a, c, t, g, unknown or other
  misc_feature (557)..(560): n is a, c, g, or t
  modified_base (562)..(566): a, c, t, g, unknown or other
  misc_feature (562)..(566): n is a, c, g, or t
  modified_base (568)..(572): a, c, t, g, unknown or other
  misc_feature (568)..(572): n is a, c, g, or t
  modified_base (574)..(582): a, c, t, g, unknown or other
  misc_feature (574)..(582): n is a, c, g, or t
tcagactgtacagtcacgaccggtgctcgattttagtgctatagacttggggtttgggagaagaacctactatgcagactctgtgaagggtcgattcaccacctccagagacaacatcaagaactccctgtatctgcaaatggacagtctgacacctgatgacaccgcctttgtatttattgtgtggaaaggtcggtgttggaggtgaatcgccgtcggaacccccgnggtcacgctactacttctacagtcgggacgtcgtggggacaaaggggactacggcatccgtctcctcacgcctccaaccgaacggcccctacgtccggttcccttccccccgtggcccgtcccgttcgacccgtccgaacgggcgcccgtaacccgtccgaacggtacgcccgaacgaccgggccggcccgtggggcccgttcgcccggtaggtcgaaacggttccttaaccctacgtacgttacgtactacgttcgtcgacgggtccgggtcgtcgggaccgaacgggaccgtcgaaagttcgcgtatcgnnngnngcgnnngnnngnnnngnnnnngnnnnngnnnnnnnnn

SEQ ID NO: 19745 - DNA, 851 bp, Homo sapiens
  misc_feature: GYAE6OF01EJ6BX.25.86.H09.1.454.CMB.1.raw
tcagactgtacagtcacgaccggtgctcgatttagtgctatagacttggggtttgggggcaggagtcagacccactcaggacacagcatggacatgagggtccccgctcagctcctggggcttctgctgctctggctccaggtgccaatgtgccatccagttcgacccagtcctccatccctcctgtctgcctctgttcgagactatacgtccacctatctacgttggtccgggtctaggtcgggtcagttggctagtgtctttagccgtggtatcgagacaacggaaaccggaggggaacgtcctaccgtaagccttccgtgtactttcgtttaggacttccgtccttacgttacggttttaaggaaggttacggtaccgtaccctaagttaccgtaagggtttcccgaacgggtacggtacgtaggttacgggtaacggtaccggtacggggtaaacgtaacggttaactttccaccgtttaccctacctaaccgtaacgtaccgtaacggtacccgtaaccggtcccgtacgacccgtaccggtaccgttaaacggtaaacgttaccgtttaccgtaacccggttaaacctttaacccgttttaagttttaaccggtttaaccgttaaaccgtttaaaaccgtttaaacggttttaaacccgggtttaacccttttaacccccttaccgtttacccgtttcccggggttaaccggggtaacccggggtaaaccggggtaaacccgggtaaacggggttacgggtaaaccggttaaccgttaaaccggtaaaaccggttacggtaacgggttcgggtacccgtaaccggtaaccctacccggttaaccg

SEQ ID NO: 19746 - DNA, 765 bp, Homo sapiens
  misc_feature: GYAE6OF01DKWXN.25.86.H09.1.454.CMB.1.raw
  modified_base (733)..(765): a, c, t, g, unknown or other
  misc_feature (733)..(765): n is a, c, g, or t
tcagactgtacagtcacgaccggtgctcgatttagtgctatagacttgggtttgggagaagaacctactatgcagactctgtgaagggtcgattcaccacctccgagacgaacaacatacaaacgacctccctgtactctgaacaaagtcggaacgtacgtctacgacctaccgtgagtacgacccgtacccgtcctttagttatttagttggtaggtaagggaaaggggtcggttaggttggaagggttagtaacgtccggtacccggtaaccccgggaacccccggtcggtaccgacgtaccttaacctttaccgtttaccgtaacgtacgggttcggggtccggttacggggtaacgggggaaaccggtaaaaacggggtaccgttaacccgggttctaaccgtttccggttcccttacccgttacccgaccgtacccccttaaccccggaaaccccggaaacccgggtccccttaacggtttcccccggtttccccctttccccggtccggccccgtcccgtccgtacccgtaccggaacggccgtaaccccgtccccgaacgggaggaccgaccgaacggccggccccgggtcccggtcgggccgttccggtacccggtgggtaaccgtaaccggttaaacccttccgttacccgtaaggtcttaaaccggtcggttctacgggacgggtccggtacggtacgggacggaccggtacacgtaagtcgnnnnnnnnnnnnnnnnnnnnnnnnnnnnnnnnn

SEQ ID NO: 19747 - DNA, 595 bp, Homo sapiens
  misc_feature: GYAE6OF01A6FY1.25.86.H09.1.454.CMB.1.raw
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
  modified_base (451)..(451): a, c, t, g, unknown or other
  misc_feature (451)..(451): n is a, c, g, or t
tcagactgtacagtcacgaccggtgctcgatttagtgctatagacttgggtttgggggggacacctggggacactgaactggtgctgagttactgagatgagccagccctgcagctgtcgtccagcctgcccatcctctgctcatttgcatacttcccagaacactaacctctgcctagaagtactttcttagtaggctggtcacacttctgcagggactcaacgacccactcgaggacctacaggtcaagtcggacagtcggacgggtccccntcgacgcttccgtggggtccttctcgctcgcttcgtcggtccnccgaggtcacctaaatcgtcgactacgtaccacggttcaccctagtcctacctacgtccctccgtcgtctccgtctcttcgtagacacgtatacgctactctctagtcggtcggcttacggtcgtactgtcggntacggttatcgtttacgcttggactccgtagacgaacggaacggaggtactcgtacaacggtccttcgagttacttcgttagtctaccgttcgtaccgttaggttacgggtaacgtacggaccttcccgtagttcggtaaccgg

SEQ ID NO: 19748 - DNA, 711 bp, Homo sapiens
  misc_feature: GYAE6OF01DSN8L.25.86.H09.1.454.CMB.1.raw
  modified_base (205)..(205): a, c, t, g, unknown or other
  misc_feature (205)..(205): n is a, c, g, or t
tcagactgtacagtcacgaccggtgctcgatttagtgctatagacttggggtttgggggcaggagtcagacccactcaggacacagcatggacatgagggtccctgctcagcctcctgggactcctgctgctctggctcccagctatcagatgtggcatccagatgacccagtctccatccctccctgtctgctatctgttgganacagacgtcaccatcgacttggccgggcgagtcgagggctagttaggtaaatttgtttggccttggtactacgacggacaacggtaaaaccgagggtaaaccttccctaacctcctactacgtctagtcgcttgactactccttactttcggactaaggtttccggggtaccctcgtcgtattacgacggtcggacgtagggtcgggtcgtacgggaactaggtaacttcctacctactaccaaccgtataccgacgaccgtacggtccctagaccgtaccggtactaagggaacgttacgtttagtacggtaacctttaaacgttttaacgtttaacgttaacgttaaaacgtttaaaactttacggaccgttacggttaacccggtacccgggttaggtacggttccgggttacccgggaacccgggtaacggggtaacccggtaaagggtacggaaaccgtaacgttaaaaccgtaaacgggtaacttcgggtaggtacccgg

SEQ ID NO: 19749 - DNA, 872 bp, Homo sapiens
  misc_feature: GYAE6OF01EJ646.25.86.H09.1.454.CMB.1.raw
tcagactgtacagtcacgaccggtgctcgatttagtgctatagacttgggtttggggagctctgggaaaggagccccagccctgagattcccaggtgattccattcggtgatcagcactgaacacagaactcaccagtggtagtttggactggtagtcgttgggtttttccttgtttcgtaccttaagtttttaaaaacgggtgttccaggttgtaggaagttgactaacgttgggtggaggttcggtgggggacgtccggtaggtaaccgcggggcccgggggggtccctaggaacgtccgttccgttccgtggtacggtacgtcccgttcgtaggtacttcgtagttgttttagagttgtacttatgacctatgcctacggtacgggtccggtacggtaacggggtcccggggaaggttccggtagggtaggttccgggttcttccgttcgtttaggtcgttacggttagggtagtacggggtaaacaaacggtaccccgttaagtagtacgtaaccgtacggtaacctttcgtaggttacggggtaacggtttcgaccgtttaacccgacccgtaacccgttaccgaacgaaccgtaaaccgtaactaaacgtaaccgtaaaaccgtaccccgttacccgtttagttacccgttacgtataaccgtaaacggttacgaacgttaccgttacgtaccaacccggtactacgttacgaaccgttacccgtaccgtttacccggtttatttaacgtttccggtaggttacgggttaaagggttacgggttacgggtttagggttaacggtggtttaacggtaccgttacggggacccccgttaaccccggggtacccccgtgggttaacccc

SEQ ID NO: 19750 - DNA, 797 bp, Homo sapiens
  misc_feature: GYAE6OF01EPYKW.25.86.H09.1.454.CMB.1.raw
  modified_base (241)..(241): a, c, t, g, unknown or other
  misc_feature (241)..(241): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctccaggtgccaaatgtgccatccagttcgacccagtctccatccctcctgtctgcctctggttcgagacatagtcaccatctacgtggtcgggactaggtcgggtntacgttggctagtcgtctttagtcctggttatcaaggacaaacggaaaacccgaggggggaaactcctaccgtaaacggccttcccgttaggtaactttccgttttagggaacttcgggtaccccttaccgtaagggtttttaacgggtaaaacgggttcgggtaaccgttaccccgtagttaccgttaaaagggtttccgaagggccgggtacgaacgggttggtaacgttcggtacgggactaacggtactttacaacgttccctacctaacctatacaacggtcacggtcccttaggaccgtacggccgttaagaacgtacgtttccgtacggtaaccttaaccttaagtttaacgttacggttaactaaaaccgttaaagtttaaacggttacctttaccccgttacttacccgttacgggttacccggggaaaccgggtacgggggtaacccgtaaaggggttaggggaaaccgttaaacggtaaaccgtaaaaccgggttaacggttacgggttaacgggacgttaacgacccgttaaccgttaacccgg

SEQ ID NO: 19751 - DNA, 504 bp, Homo sapiens
  misc_feature: GYAE6OF01BJDMM.25.86.H09.1.454.CMB.1.raw
  modified_base (218)..(218): a, c, t, g, unknown or other
  misc_feature (218)..(218): n is a, c, g, or t
  modified_base (339)..(339): a, c, t, g, unknown or other
  misc_feature (339)..(339): n is a, c, g, or t
  modified_base (476)..(504): a, c, t, g, unknown or other
  misc_feature (476)..(504): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacagtgggcgtcgtgggggacaaagggctacggtcatcgtctcctcagcctccaccaagggccccatccggtccttcccccgtggccgccctgcctccgaggacncaccgtccgagagcacgagccggccctgggctcgccgtgggtaccaaagggtaccttaaccttccgaacgttgtaaccgtagttccgtggaacgggcggggtcgtacgggaccgaaaggggcctacgaagttacggnnnnnnnnnnnnnnnnnnnnnnnnnnnnn

SEQ ID NO: 19752 - DNA, 715 bp, Homo sapiens
  misc_feature: GYAE6OF01DQYPX.25.86.H09.1.454.CMB.1.raw
  modified_base (689)..(689): a, c, t, g, unknown or other
  misc_feature (689)..(689): n is a, c, g, or t
  modified_base (696)..(696): a, c, t, g, unknown or other
  misc_feature (696)..(696): n is a, c, g, or t
  modified_base (709)..(709): a, c, t, g, unknown or other
  misc_feature (709)..(709): n is a, c, g, or t
tcagactgtacagtcacgaccggtgctcgatttagtgctatagacttggggtttgggggcaggagtcagacccactcaggacacagcatggacatgacgggtccccgctcagctccgtggggcttctgctgctcgtcggcctcccgaggtcgacctaaatggtcgccatccgagttcgaccctagtcctccactccctcccgtgtcctcgtccttcgtcggttacgagacagtacgtaccacctattcgtacgttcggtccgggtacttgggtcggtctaggttcggacgttagtcgttcgttacggtcgtagttactcgaacgacgaaacggaaaccggagggaactccgtaccgtaacgtcccgttactacgtactttacgttacgtcgtacccgttccgttacggtagggtttaaggtaacgggtcgtaaccgtacccgtaacgtacggtaacggttcgacggtcggtacgtaaggtggtaactcggtacggaagttacgttacttccgtacttccgaactacttcacgtacgccgtaggtccaggcctacgaccggtaataacgtcttacgacctaaccgttatttagttacgttaccaacgttaaaccgttaagtaccttacttcccgtcgttaccggtacggtcgggaccggtagtaacgtacggtagattacgagtaaccgngtacggntaccgctaaccgngttacg

SEQ ID NO: 19753 - DNA, 543 bp, Homo sapiens
  misc_feature: GYAE6OF01A819I.25.86.H09.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (411)..(411): a, c, t, g, unknown or other
  misc_feature (411)..(411): n is a, c, g, or t
tcagactgtacagtcacgaccggtgctcgatttagtgctatagacttgggtttgggggcaggagtcagacccactcaggacacagcatggacatgagggtccctgctcagctcctgggactcctgctgctctggctcccagctatcagatgtggcatccagatgacccagtctccatccctccctgtctgccatcgtgttggagacagatcaccatcacttgccgggngagtcagggcattggaaattnttggcctggtatcagcagaaaccagggaaattccaaacctctacatctatgctgcattccaactttgactaatttcggggccctntacgattcagcgnaggtggtacngggacagatactactctacacatacagcacgctgacagctagaagtagttgtanactaacttacttacgttaacgtaataaaacttagaacgtagtacgaccgttaggtagtacggttcggacccggtaacggaaccgtaaacgggtacgaaacgtaactaaccgaaaacgtaaacgttagtggtc

SEQ ID NO: 19754 - DNA, 907 bp, Homo sapiens
  misc_feature: GYAE6OF01BZ6Y2.25.86.H09.1.454.CMB.1.raw
  modified_base (458)..(458): a, c, t, g, unknown or other
  misc_feature (458)..(458): n is a, c, g, or t
tcagactgtacagtcacgaccggtgctcgatttagtgctatagacttgggtttggggggacacctggggacactgaactggtgctgagttactgagatgagccagccctgcagctgtgtccagcctgcccatcctctgctctatttgctatactcccagaaccaccaacctcctgcccttagaagtacctttgttaggacgtcgtggtacctactacttcgttgacgagggtactccgaccgaccctacgcgaacggtaccacgacggaccaggtaggacgtaacggtacgggaaccgggtccccggtactacgaccggtccgttccgggtcgggtcgttccgtcggtcgtcgtccgtcgttcggcctaccgtacggtaccgtaacgtaacgtcggtactaccgtacgtaccgttacgtaccgtacccgtcgttacctacctattcccccccccgttntccgttcctccgtcccgttcttacgttacgacgtaaccgtacgtaaccgtaccttaccctacgtttaccgttaccggtttagggttcccgggttacggttaacccgggtttaccgggttacgttacggtttcggtaaccggtttacggtttaccggtttaccgttttaacccgggtcgttaacgtttaccgaccggttaaccggaacccggttaaaacccgggaaaccgggtaaccgggtaaccgtaacccgttaacccggttaccggttaccccgttaggttaaacccgtttacggtttacgtttacccggttaacggttacccggtttaaccccgggtttaaacccgggttttaaaggggttacccggggtttaaaacggttaccccggggttaaaaccccggtttaccgttttaacccgggtaaaccgggttttaaaacccggggg

SEQ ID NO: 19755 - DNA, 553 bp, Homo sapiens
  misc_feature: GYAE6OF01C4F64.25.86.H09.1.454.CMB.1.raw
  modified_base (368)..(368): a, c, t, g, unknown or other
  misc_feature (368)..(368): n is a, c, g, or t
  modified_base (526)..(553): a, c, t, g, unknown or other
  misc_feature (526)..(553): n is a, c, g, or t
tcagactgtacagtcacgaccggtgctcgatttagtgctatagacttgggtttgggagaaagaacctactatgcagactctgtgaagggtcgattcaccacctccagagacaacatcaagaactccctgtatctgcaaatggacagtctgacacctgatgacaccgccttgtattattgtgtaggaaaggcggtgttggaggtgaatcgccgtcggaacccccgcggtacagcactacttctacagtgggcgtcgtggggacgaaagggacgtacggtcactcgtctcctcacgccctccaaccgaacgggcccctacgtccggttcccttcccccgtcggtccctacccctcctaccaaaggtaccnccgtacccgtcggtcggggccaccgacggcccggcccgtcggggtcctcggcccgttacgggtacgaaacgtaccctttaaccctcccgtacgttcgtacgtacgttcgtcggacgggtccgggccggtacggccggaacggccggaactacgtaagnnnnnnnnnnnnnnnnnnnnnnnnnnnn

SEQ ID NO: 19756 - DNA, 599 bp, Homo sapiens
  misc_feature: GYAE6OF01BIYB6.25.86.H09.1.454.CMB.1.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggacagtctgacacctgatgaccacgccttgtattattgtgtgaaggcggtgttgaggtgaatgcctcggaaccccgngtcagcactcttcacagtcggcgtcgngggacaaaggactacggtcactcgtctcctcgacgcctaccaaccgaacggccccaggttccgttcccgttcccccgtggccgccccgttgccctccgaaggtcgtccacccgtccgaagacgaccgacgacggcccggcccgtgggcctcggccgtaggttacccgaaacgggttacctaccgttacccacgttacgtaaccgtacgggttcgaggtaaccggtccgggacgttacggggaaccgaacgggccgtaacgagttaacgcgtancgtgcgcgngngngngagancgtcgacgacgtcgacncgacgacgtacngtgctnctctacgacncncacgcnctgtcgcg

SEQ ID NO: 19757 - DNA, 707 bp, Homo sapiens
  misc_feature: GYAE6OF01EI9BB.25.86.H09.1.454.CMB.1.raw
  modified_base (467)..(467): a, c, t, g, unknown or other
  misc_feature (467)..(467): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccgagttgaccctagtcctccactcctccctgtctcgcctcgtgtcgagactatacgtcaccatctacttggtcggctaggtcggtctagttggcagtgtctttagcctggtactcagcgaacgaaaccgaggggaacgtcctaccgtaagtcctcgtgtactttcgttgtatccgtccgttacgtaggtttacggaaggtcggtacgtacccgtagtaccgtaacggtcgacggcgacgtaggtcggatcggtaggtactagttacttacgtacgttaccctaccgactactcgacgtacgacgtcccnggtaccacgtccgtaagaacgtacttaccgtacgtaaccttaaccgtttaagttacgttaacgttaaacgtaaacgtttaaacgtttaaccggtaacctttccccgttaccttaccggttaccccggttacggggacccggggttaaacgggtaccgggtaaacgggttacgggtaaacggtaacgtaaaccggtaaacgtaccggttggttaccggaccgttacgacccgacgttaccg

SEQ ID NO: 19758 - DNA, 670 bp, Homo sapiens
  misc_feature: GYAE6OF01B0RFK.25.86.H09.1.454.CMB.1.raw
  modified_base (393)..(393): a, c, t, g, unknown or other
  misc_feature (393)..(393): n is a, c, g, or t
tcagactgtacagtcacgaccggtgctcgatttagtgctatagacttgggtttggggggcaggagtcagacccactcaggacacagcatggacatgagggtccccgctcagctcctggggcttctgctgctctggctcccaggtgccaaatgtgccatccagttcgacccagtcctccactcctccctgtctcgcctctgtcgagacatacgtccaccatctacgttggtccgggctaggtcgggtacagttcggcagtgtcgtttagccgtggtatacgacgtacgaacggaaaccggaggggaactcgtacctagtacctccgtacgtacttcttagactcgacctacgtaggtttaggaagtggtactaccgatacgtaagtcgagcggngtaggtgactcgtaggactagtacttacacgttccctacaaccgtcttacgacggtccaccgtccgtacgaccgaccgtacgttaacggaacttacttcgtaccgtaactaacctttattacctttacggtaacctaaacgtttaacggtttaaccgtaccttaccccttacgtcgttccccggtagggaccgggaacgggtaaccggtaaggtacgggtaactaaccgttaacgaaaccggttacgtacggtcgacgtacgtaccgtaccttaacg

SEQ ID NO: 19759 - DNA, 867 bp, Homo sapiens
  misc_feature: GYAE6OF01CH2H4.25.86.H09.1.454.CMB.1.raw
tcagactgtacagtcacgaccggtgctcgatttagtgctatagactttgggtttgggggcaggagtcagacccactcaggacacagcatggacatggacgggtccccgctcagcctccgtggggtcttctgctgctcgtcggtcctcccgaggtcgacctaaattgtcgcctactaccgtagtttaccgacccgtacgttccctaccctacttcccccttccccgttcggttcccgtccgttccccgttcgtttcggttaccggaaacgtaacctaagttaccgtacccaacccttacgttaccgttacggtttcgggtccggggttacggttacggggttccgggttacgtagtttcgggacgtaggttcggttacgtttaccggtccgttaggttacgtacgacgaaccgaacggaaaaccgggtacggggaactcccgttaccgtaacgtccgtacctagtactttcgtttacgtacgtccgtaccgttacggttaaggttaggtaacggtcggtaccgtaccgtataacggtaacgtacgacggtcgaggttaggtaggtacgtacggtacggaacgtacgtttacttactacccgtacctacgtaacctcgtacgacgtcacgttcgacgtacgaccgtacgtaagtaacttacgttaccgaacgttaccctttaaacgtttatttacgtaaaccttaactaaaacggttttaacgttaaccgtttaccccttaaccgttcccgttacggtttacccgggacgggtaacccggggaagtacccggtaacggggtataccggtaaacctaaacggtaacccgttaagggttccggacgttaccgacccgttacgccgtttacg

SEQ ID NO: 19760 - DNA, 783 bp, Homo sapiens
  misc_feature: GYAE6OF01BFH4F.25.86.H09.1.454.CMB.1.raw
  modified_base (294)..(294): a, c, t, g, unknown or other
  misc_feature (294)..(294): n is a, c, g, or t
  modified_base (468)..(468): a, c, t, g, unknown or other
  misc_feature (468)..(468): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtccaccatctacgttcggtcgggtctaggtcgggtactagttggctagtgtctttagcctggtactcagcaagaaaccggaggggacnctaccgtaagcctaccgtgtacttcgtttagacgtcgtcccttaccgtaagggtttaggaaacggtggtaaccgtacctagtaccggtaacggttccgacggtcgggacgtaggtcggtacgtacggtagggtaactacggttactttaccgtactttcccctacaaacccgtntaccgaacggtaccctaacggtcccgtcgaaccgtaccgggtccctaaagggtaaccggttactttcccgaacggttaacccttaaaccgtttaatttaccggttaacgttaacctaaaaccgtttaacgttttaaaccgggttaacccctttaccccgttaccgttacccgttacccggggtttacggggtacccgggggtaaaacgggttaacccggtaaagggggttaccgaaacggttacggttaaacccgaaaacgggttacgttacgggtaccggtaacccttacggtaaccccgtaaacgtttcccgg

SEQ ID NO: 19761 - DNA, 721 bp, Homo sapiens
  misc_feature: GYAE6OF01CAO2G.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccagtcctccctgtctgcctctgtcgagacatagtccaccatcacgttggtcgggctaggtcgggtcagttggcagtgtctttacgccgttggtatcgacgaccgaacggaaaccggaggggaactccgttaaccgtaacggtccttaccgtgtacttacgtttacgacgttccgtcctacccggttaggtttaacgggtaacggtacggtaccgtacccgtagtacgtaacgggttcgacggcggtacgtacgggtaggtacgtcggtagggactaggttactttcgacctcccgtacaaccctagtaccgacgtccacggtaccctagaccctacgtaccgtaagacgttacttccgacttaacccgtaactttactttacgttaacgtaaccgtaaacgtttaaacggttttaaccggacccttttacccgtccgttacccgttaccgggttaaccggggacgggtaaacccggtaggtaacgggtacgggtataacccgtaacggaaacgttccggtgaacggtccctaggtactccgttacg

SEQ ID NO: 19762 - DNA, 655 bp, Homo sapiens
  misc_feature: GYAE6OF01DH7N1.25.86.H09.1.454.CMB.1.raw
  modified_base (627)..(655): a, c, t, g, unknown or other
  misc_feature (627)..(655): n is a, c, g, or t
tcagactgtacagtcacgaccggtgctcgatttagtgctatagacttgggtttgggagaagaacctactatgcagactctgtgaagggtcgattcacccacctccagagacaacatcaagaacctccctgtatctgacaaatggacagtctgaccacctgatcgaccaccgtcttgttattattgtgtagaaggtcggtgtggaggtagacgtcgccgtccggaacccccgtcgtcgagcctacttaccttacctacgtaggtcgggtccgtcggtggggaacgaaaggaccgtacggtcacgtcgtcctcctacaccgtccctaccccgaacggaccgggccccttacgttccccggtttaccccctcccccggtacggtccccgtccccttacggcccgttaacccgacgggtaaccgtccccgtaaccccggtcccgaacggaccgacccgaaccggtacccgggtccccgggtccccggtagggtcccgtccgggtacccgtaacggtaccgaaaccggtccctttaacccgtcccgtaacgttaggtaaccttacgggtcccgtaagggccgggtcccgggtgaacgggaaccgtaggggtaccctagagtagctgctcgannnnnnnnnnnnnnnnnnnnnnnnnnnnn

SEQ ID NO: 19763 - DNA, 529 bp, Homo sapiens
  misc_feature: GYAE6OF01EUFLE.25.86.H09.1.454.CMB.1.raw
  modified_base (499)..(529): a, c, t, g, unknown or other
  misc_feature (499)..(529): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtgaaaggcggtgttgaggtgaatgcctggaacccccgcggtcagcactacttctacatgggcgtcgtggggacaaagggactacggtcatccgtctcctcacgcctccaccgaacgggccccagtccggtccttccccctgggcccgccctcgcctcccgaggacgccaccctccggacgacgaccacgacggccggcccgtggggcctcgccgtcggtacgaaacggaccttaccgtttcccacttcgtacgtacggttccgttaggaacgggtccggggcttacgggggacctaaacggggcgtaccgaagttacggnnnnnnnnnnnnnnnnnnnnnnnnnnnnnnn

SEQ ID NO: 19764 - DNA, 602 bp, Homo sapiens
  misc_feature: GYAE6OF01AX8C9.25.86.H09.1.454.CMB.1.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (569)..(572): a, c, t, g, unknown or other
  misc_feature (569)..(572): n is a, c, g, or t
  modified_base (574)..(574): a, c, t, g, unknown or other
  misc_feature (574)..(574): n is a, c, g, or t
  modified_base (576)..(602): a, c, t, g, unknown or other
  misc_feature (576)..(602): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgcttgtattattgtgtgaaaggcggtgttgaggtgaatgcctggaaccccccgnggtcagcacttacttctacngtgggcgtcgtggggacaaagggctacggtcatcgtcctcctcacgccctaccaccgaacggggccccctagtccgggttcccttccccccgtggcccccgtccctggccctcccgagggaccgccctacccgtcccggaagacgccaaccgacggcccgggcccgttggggcccttacgggcccctaggggttaacccaaacgggtaccctttaaccctttcccgtaaaccgttcgtttaaccctacggttccggttacgggacgggaccgggggtccgttaccggggacccgaaacggggtccgaccgtaaacgttaggagtcgcagtcnnnngncnnnnnnnnnnnnnnnnnnnnnnnnnnn

SEQ ID NO: 19765 - DNA, 720 bp, Homo sapiens
  misc_feature: GYAE6OF01C99D6.25.86.H09.1.454.CMB.1.raw
  modified_base (221)..(221): a, c, t, g, unknown or other
  misc_feature (221)..(221): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgccattttaaaggtgtccagtgtgaagtgcaactggtggagtcgtggggganccgtggtacgacgggcccggggggtccctgagactcctcctgtgtacgcctgtggattcattgtttgatgtacttatgacctatgctacggtgggtccgtacgaacgggtccggggaaggtcgtagggtagtcgggtactcgttacttagtcgtacggttgggaacgtgggaacgaaacgtaaccttacgtagtcgacgtagtaccgtcgttaggaggtaaacggttcgtaacttcccgaacctaccctacccgaagacgaactaacataacaaacgtaacccttcctagtattcacgaactaaagtcggaactacgtctacgaactacgtacgtacgtacgtaacccgtcccggttacctttaagtttaaccgttaggtttaggttaggttaaacggggtaacgggttacggggtttggttaacgggttaagggtacgttaaacggttcccggaccccgggttaaccccgggaccccccgggttagggttaaccccgg

SEQ ID NO: 19766 - DNA, 625 bp, Homo sapiens
  misc_feature: GYAE6OF01C3EIB.25.86.H09.1.454.CMB.1.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctaggtcggcattggcagtgctttagccttggtactcagcaacgaaaccgaggggaacncgtcctaagctcctgatcttgatcgcctacgtagtttggaaagtgacgtccatacgaaggttcagcggcaggtggtactcgtagggacagtactttcactcctacaccatcgagcacgctgacgcgccgtagaatgttcctacgtacctaaaccgtttatttacgttagtaaccctaaagtttaagttttaacggaaccttttaacccccgttcttacccgtttacccggttcggggaccgggtaacggggtaacccggtaaagggtcggtaaacgtaacgttaaccgaaaacggttaaccgttcgggtaccggtacgtttaccggcctaacccgttaacgg

SEQ ID NO: 19767 - DNA, 691 bp, Homo sapiens
  misc_feature: GYAE6OF01BNPSO.25.86.H09.1.454.CMB.1.raw
tcagactgtacagtcacgaccggtgctcgatttagtgctatagacttgggtttgggggcaggagccagacccactcaggacacagcatggacatgagggtccccgctcagctccgtggggcttctgctgctctggcctcccgaggtcgaccaaatgtcgcctatcctagttcgacccagtcctcctactccctcccttgtcctcgtccttcgtcggttcgaacgactattacgtccacctactacgtacgttcggtcgggtacgttacgggtcgggtactagttcgggacctaggttcgttaccgtttacggtccgtaggttactcgaacgtacgaaacggaaaccggaggggaactccttaccgtactccgtactgttacttcgttagctcgtccgtacgtaggttagaacgtggtactaccgtacgtacgtacggtacacggcggtacgtcggtcgtcgtacggtaggtacgtagttcgttacctaccgttccaaccgtataccgacgtacgacgtccgtacgctacgacgtcgtaagcttcgacgtacaactttactagttactacgtaactaacgttaacttaccgtaccttccgtcttaccgtacggtacgggacggtaacgtcgggtaagtccgtaataacgtaaccgtaaacggttcgtacgggcgtactacgccgtgttaccg

SEQ ID NO: 19768 - DNA, 728 bp, Homo sapiens
  misc_feature: GYAE6OF01BO5TZ.25.86.H09.1.454.CMB.1.raw
  modified_base (522)..(522): a, c, t, g, unknown or other
  misc_feature (522)..(522): n is a, c, g, or t
  modified_base (542)..(542): a, c, t, g, unknown or other
  misc_feature (542)..(542): n is a, c, g, or t
  modified_base (603)..(603): a, c, t, g, unknown or other
  misc_feature (603)..(603): n is a, c, g, or t
  modified_base (715)..(715): a, c, t, g, unknown or other
  misc_feature (715)..(715): n is a, c, g, or t
tcagactgtacagtcacgaccggtgctcgatttagtgctatagacttggggtttggggggagtcagacccactcaggacacagcatggacatggacgggtccccgctcgagctccgtgggtcttctgctcgctcgtcggcctacccgaggtcgacctaaagtggtcgacctactccgtagttccgaccctagtcctcctacttccctcccgttgtccgtcgtccttcgttcgttacgaacgactacgtacgtaccaacctacgtccttacgttcgggtccgggtacttacgggtccgggtactagttcggacgtagttcgttacgtttacgccgttaggtactacgtaacgtaaccgaaaacggtaaaccgggacggggtaacctcccgttaaccgtaacggtccttccgtagttactttcgttagtactccgtccgtacggttaggttacggaacgtcggtacctaccgacgtacggtacgtcgacggtcgacgtaggtgtacgtggacggtactacgttntaccgacctaccactcgtanacgacgactcgtcgagcgtacgtccgtagtaacgttctaccgtctaaccttattacgttanactaactaagttacgtacgttcctacccgttcttccggtccgtacgggacggtaacggtacgtaggtacgaacgttacgtaaacgtaccgtgtcgtacgtacgctaaccctnttccgtgttaccg

SEQ ID NO: 19769 - DNA, 745 bp, Homo sapiens
  misc_feature: GYAE6OF01A5VEG.25.86.H09.1.454.CMB.1.raw
tcagactgtacagtcacgaccggtgctcgatttagtgctatagacttggggtttgggggcaggagtcagacccactcaggacacagccatggacatgagggtcccccgctcagctcctggggctctgctgctctcggctcccgaggtgccaaagtgtcgccatcccgagttcgaccctagtcctcccaagttccccgtcccctgtcctcgtccttcgtcgttcgagtacctatacgtccaccctatcctacgttggtccgggtcttaggtccggtacagttcggcctagtgtaccgttttagcccgtggttaacctcgacggacaaacggaaaccggaacgggggtaacgtacccttaccgtaaacgccgtttccgacggtaactttccggttttaggaaccgtttccgtcccgtttaacccggtaagggtttttacgggaaaaacgggttccggggtacctaaccccgtagtttaaccggtaaaacgggtttacgacgggtacggtcgaggttacggtacgtaccgggttaggaacctaacggtactttactaccgttaccctcgaaacctacgtcacgtcgaacgtcctgaccacgacctaggaatctctacgtaccttaacttacgtattaaccgtactaaacgttacttaaggtccttaccctcttacctccggttcgcgggtaacggaacgtaagggtgactacgacgaaactcggtcgacgacccttcgaccgtcctag

SEQ ID NO: 19770 - DNA, 727 bp, Homo sapiens
  misc_feature: GYAE6OF01BJ42G.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctccgtggggcttctgctgctctggcctcccgaggtgaccaaatgtcgccatccagttcgacccagtctccactccctcctgtctcgcctcgtgttcgagtacatacgtccacctatccgtacgttcggtccgggacgttacggtcgggtctagttggctagtgtctttacgcctaggtactcgacgacgaacggaaaccggaggggactcctaaccgtaagccttactagtactttcgttagcgtccgtccttacgttaagggttacggaaaggtcggtacctaccctagtacgtacggttccgacggcgtagtacggtgaacgtcggtagggtaactagtttacttaccgtacctccctaaccgtaccatacgacgtaccgaccgtccgttaagccgtacgtccgtaagtacgttacgttccgtaacctaacgttaacctttatttaacgtacgttaaaccaaaaggttttaacgttaaccggttaccttacccttacgttacccgttacccgggtacggggtaacccgggtaacgggtaacggacgggttaagaccgtaacgtaaaccgtaaacggttccgtaagggtccacgtacccgtacgaccgtttaccg

SEQ ID NO: 19771 - DNA, 526 bp, Homo sapiens
  misc_feature: GYAE6OF01A0CSZ.25.86.H09.1.454.CMB.1.raw
  modified_base (293)..(293): a, c, t, g, unknown or other
  misc_feature (293)..(293): n is a, c, g, or t
  modified_base (505)..(526): a, c, t, g, unknown or other
  misc_feature (505)..(526): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgacaaatggacagtctgacacctgatgacaccgccttgtattattgtgtaggaaaggtcggtgttgaggtgaatcgccgtccggacccccgcggtcagcactacttctacagtgggcgtcgtggggacgaacgggaccgtacggtcagtcctctcctcncgccctccaccgacgggcccacgtccggtccttcccccgtcggccgccccgtcgcccgtccgacgggacgcccgaccccgtccggagaccgcaccgacgcccgggcccgtgggcgtcggcccgtcggtacgaacggtaccctccttacccgtacgttacgtaccgtaggtcgtggacgggcgggtcgtcgggacgaacggcggacacgtagnnnnnnnnnnnnnnnnnnnnnn

SEQ ID NO: 19772 - DNA, 810 bp, Homo sapiens
  misc_feature: GYAE6OF01AECCJ.25.86.H09.1.454.CMB.1.raw
  modified_base (470)..(470): a, c, t, g, unknown or other
  misc_feature (470)..(470): n is a, c, g, or t
tcagactgtacagtcacgaccggtgctcgatttagtgctatagacttggggtttgggggcaggagtcagacccactcaggacacagcatggacatgagggtccccgctcagctctggggcttctgctgctctcggcctcccgaggtcgacctaaagttgtcgaccacttccgtacggtttacgacccgtagtccctacctactcccttccgtgtcgtcgtccttcgttacgtacggactactacgtacgtaccacctactacgtacgttcggtccggtacgttacggtcggtactagtcggacgtcgtcgtcttacgtccgttgtactcgaacgacgaaccggtaacggagggtactcctacgtacgtcctacgtagtacgttcgtagaccgtacgtcccgtagttacggtacggtaaggaccgtaccgttaccgtacggttacgtaaacggttcgacggacgtaccggnggtacgtacggttacgaggttaacgtacgttacttaccgtactacccggtaactaaccgtacgtaccacgtaccgacggtccgaaccgaactcgggtaactccgggttatacccgtacttaaccgtaacgttaccgtttaagttacgttaaccgttaactaaaccggtttttaaaccggtcccttaaacccgtttccgttaccggtaacccgtttaccggggtaaccgggtaacggaacccggggttaacgttaaggggtaaaccttcggtaaacccgttaaaacggaccccggttagttcccggacgttaacccgacctttaaacccggtcttcccggg

SEQ ID NO: 19773 - DNA, 528 bp, Homo sapiens
  misc_feature: GYAE6OF01A3CZM.25.86.H09.1.454.CMB.1.raw
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
  modified_base (495)..(495): a, c, t, g, unknown or other
  misc_feature (495)..(495): n is a, c, g, or t
  modified_base (499)..(509): a, c, t, g, unknown or other
  misc_feature (499)..(509): n is a, c, g, or t
  modified_base (511)..(520): a, c, t, g, unknown or other
  misc_feature (511)..(520): n is a, c, g, or t
  modified_base (523)..(528): a, c, t, g, unknown or other
  misc_feature (523)..(528): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgacaaatggacagtctgacacctgatgacaccgtccttgtattattgtgtgaaaggcgtgttgaggtgaatgcctcggaaccccgnggtcagcactactctacagtggcgtcgtggggacgaaagggtactacggtactactccgtcctcctcacnccctaccaccggaacggccccacttccggtcccttcccccgtggcctcccgtcgcctccgaggtacgcctaccgtaccgagacgccgaaccgaacggccgggtcccgtacgggctacgccggttcggtacgaacgtacttaccgtccacgtcgtactacgtcaggcgcgggtcgtaggaccggagcgactagtaagctgcagctncagnnnnnnnnnnncnnnnnnnnnngcnnnnnn

SEQ ID NO: 19774 - DNA, 568 bp, Homo sapiens
  misc_feature: GYAE6OF01BH2W9.25.86.H09.1.454.CMB.1.raw
  modified_base (346)..(346): a, c, t, g, unknown or other
  misc_feature (346)..(346): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (538)..(548): a, c, t, g, unknown or other
  misc_feature (538)..(548): n is a, c, g, or t
  modified_base (550)..(568): a, c, t, g, unknown or other
  misc_feature (550)..(568): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgaccacctgatgacaccgcctttgtattattgtgtagaaaggtcggtgttggaggtgaatgcctcgggaacccccgcggtcagcactacttactacagtgggcgtcgtgggggacaaagggactacggtcattccgtccttcctcgtacgaccctaccaccgaacgggtcccctaagttccggtcccctttcccccgngggtcccgcccgtgtaccctccggaacggacccgcctaccctcggaagacgaccaaccgcggcccgtcccgtgggtccgtccgtccggtggttacccgaacggtaccttacgttcccctacgtacgtaccgtaagtccgttagggaccgggcggggtactcggggaccaacggggcctagacgtanagcncnnnnnnnnnnnannnnnnnnnnnnnnnnnnn

SEQ ID NO: 19775 - DNA, 539 bp, Homo sapiens
  misc_feature: GYAE6OF01CEQ6W.25.86.H09.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (515)..(539): a, c, t, g, unknown or other
  misc_feature (515)..(539): n is a, c, g, or t
tcagactgtacagtcacgaccggtgctcgatttagtgctatagacttgggtttgggagaagaacctactatgcagactctgtgaagggtcgattcaccacctccagagacaacatcaaagaacctccctgtatctgacaaatggacagtctgacacctgatgacaccgtccttgtatttattgtgtagaaaggnggtgttgaggtagatgccgtcggacccccgnggtcacgactacttacttactacgagtcgggtcggtcggtgggggaaccgaaagggtaccgtacggtcacttccgtctcctacacgcccctaccgaaccgaacggccaccgttccggtcccttcccccgnggcccnccccgtctacccgtccgaagggacccacgacccgacgagcgaccacgtcggccggtcccgtggggcctcgaccgtcggtaccaacgggtccttaacttcccgtacttacgtactaggttccgngggacggcggtacggnggacgtagcgacagnnnnnnnnnnnnnnnnnnnnnnnnn

SEQ ID NO: 19776 - DNA, 691 bp, Homo sapiens
  misc_feature: GYAE6OF01B6DV5.25.86.H09.1.454.CMB.1.raw
  modified_base (290)..(290): a, c, t, g, unknown or other
  misc_feature (290)..(290): n is a, c, g, or t
tcagactgtacagtcacgaccggtgctcgatttagtgctatagacttgggtttgggggcaggagtcagacccactcaggacacagcatggacatgagggtccccgctcagctcctgggggcttctgctgctctggctcccaggtgccaaatgtgccatccagttcgacccagtctccatccctccctgtctgcctctgttcgagacatagtcaccatcacttggtcgggctaggtcgggtcattggctagtgtctttagcctggtatcagcaacgaaaccgaggggaacncctacctaagcctccgtgtacttcgtttgactcgtcccttaccgtaggttttaagggaaaggtcggtacgtacccatacgtaagggttcacggcggtcgaggtggattcggtagggactaggtactttcgacttccctaccacctactcgaacgcctaacggtcctcggactacgtacccgtaagaacgtacttaccgtctaaccttaacgtttatttaagtacgttaaactaaacgtttaaacgttttaacggttaccctttacccttcgttcccgttaccggttacggggtaaccgggtaaccgggtaacccggtaaagggttacgggtaaacggtaaccgtaaccggtaaaaccggtacggttacggttacggtaccgtacgtccgtaacccgttacg

SEQ ID NO: 19777 - DNA, 622 bp, Homo sapiens
  misc_feature: GYAE6OF01E3QLB.25.86.H09.1.454.CMB.1.raw
  modified_base (284)..(284): a, c, t, g, unknown or other
  misc_feature (284)..(284): n is a, c, g, or t
tcagactgtacagtcacgaccggtgctcgatttagtgctatagacttgggtttggggggcaggagtcagacccactcaggacacagcatggacatgagggtcccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgctttgcctgtatcagcaagaaaccgaggggaanctacctaagctcctgattctttagactcgccttcgtaggtttaggaaaggtggacgtcccatacgaaggttcacggcggactaggtggatcggtagggactagtactttcacttcccacaccatcgaacgtcgacgtcctagccacgtccgtagtaacgtacttctacgtacctaaccttattttaacgttcgtaacgtaaactttaaagttttaaaccggtacctttttacccctaccgtttcccttaccggttccgggaccgggaacgggtaacccgtaaggggtacggacgtaactaacgaaaacgtacgtcggttacggaccttcgcaccgttc

SEQ ID NO: 19778 - DNA, 643 bp, Homo sapiens
  misc_feature: GYAE6OF01EHVDW.25.86.H09.1.454.CMB.1.raw
  modified_base (222)..(222): a, c, t, g, unknown or other
  misc_feature (222)..(222): n is a, c, g, or t
  modified_base (562)..(562): a, c, t, g, unknown or other
  misc_feature (562)..(562): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (617)..(617): a, c, t, g, unknown or other
  misc_feature (617)..(617): n is a, c, g, or t
  modified_base (634)..(634): a, c, t, g, unknown or other
  misc_feature (634)..(634): n is a, c, g, or t
tcagactgtacagtcacgaccggtgctcgattttagtgctatagacttgggtttggggagaagaacctactatgcagactctgtgaagggtcgattcaccacctccagagacaacatcaagaactccctgtatctgcaaatggacagtctgacacctgatgacaccgcctttgtattattgtgtagaaggcggtgttggaggtgaatgcctcggaaccccgnggtcagcactacttctacagtggcgtcgtgggacgtaagggctacggtcactcgtctccgtcacgccctaccaccgaacgggccccctaagttccggtcccttcccccgtggggacccgtcccgttggcccgttaccggaacgggacgtacccttacccgtcccggaaggacgaccgaacgtacggcccggtccccggtagggtccgtcgtaccggtcgggttaaccaaggggtaccccttacgtttccccgaacgttacgttaacccgtacgttaccgttacgggaccgggtacgggtccgtacggggacgtaaacgggtccgaacgtaacttagactntacgactagcagtcngtaagcagntatnanncgngngagcgagcctagatacgtntcgacgtgtacagacgngtcgcgtcg

SEQ ID NO: 19779 - DNA, 937 bp, Homo sapiens
  misc_feature: GYAE6OF01ES5U5.25.86.H09.1.454.CMB.1.raw
tcagactgtacagtcacgaccggtgctcgatttagtgctatagacttggggtttgggggcagggagtcagacccactcaggacacagcatggacagtgacgggtccccgctcagctccgtggggcttctgctgctcgtcggcctcccgaggtgacctaatgtcgctactaccgtagttcgacccgtacgttcctacctaccttcccgttacccgttcgttcctcgtcccttcgttcggttaccgaacgtacctaattaaccgtaccaacccgtattaccgttaccggtttcgggtaccggggttaccgttacgggttccgggtaccgttagggttccggtagtacggttcgttacgtttacgtccggttaggtactacgacgacgaaaccggtaacggacgggtaactccgttaccgtaacgttccgttacctacgttacgtttacgttacgtacgtaccgttaccgttaccggttaagggtttaacgggtaacgttcggtaacccgttaccgttaaacgtacggtttaacggaccgacggaccgtaggtacggtaggtactacgggtaaggtacgtagttacccccctagtacccttaccggtaacctaccggtataccgtaacgtaccgtaaccgcggttaccgaaccgtacggttaccgtaacgttaaccggtttacctaacgttaacccggtaacgtttaaccgtttaactttaaccgttaacgttaaaccgtaaacgttttaaaccgtttaaacccggttaacccctttaacccgttcccgtttaaccgggttaaccgggtacgggggtaaacccgggaaccggggttaaacgggtaacgggttaaccggtaaacggtaaacccgttaaaccgggtaaaccgttaccggttacggtaccggttaaaccctacgttaacccgtaaccgttacg

SEQ ID NO: 19780 - DNA, 677 bp, Homo sapiens
  misc_feature: GYAE6OF01DPTYP.25.86.H09.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(634): a, c, t, g, unknown or other
  misc_feature (634)..(634): n is a, c, g, or t
  modified_base (638)..(638): a, c, t, g, unknown or other
  misc_feature (638)..(638): n is a, c, g, or t
  modified_base (643)..(644): a, c, t, g, unknown or other
  misc_feature (643)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (650)..(651): a, c, t, g, unknown or other
  misc_feature (650)..(651): n is a, c, g, or t
  modified_base (653)..(654): a, c, t, g, unknown or other
  misc_feature (653)..(654): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (661)..(663): a, c, t, g, unknown or other
  misc_feature (661)..(663): n is a, c, g, or t
  modified_base (665)..(667): a, c, t, g, unknown or other
  misc_feature (665)..(667): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(677): a, c, t, g, unknown or other
  misc_feature (673)..(677): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgacaaatggacagtctgaccncctgatcgaccnccgtcctttgtattagttgtcgtaggaaagggtcggttgttggaggtcgaacgtcgtcccgtacccgggaacccccggtcggttacacgtacctaccttacctttacctaacgtggttcggggtccggttcgggtacgggggaacgaaaacggggtaccgttacgggtcctacgttccggtttcctaccgttaccgaccgtcccctacccgaacccggaaaccgggtcccctccggtttccccggtttccccttcccccggttcggccccgttccctccggtaccgtccgaaggtaccgcctaacccgtcgaagccacgtaaccgcggtcccggccggtcggccgtacgccggacggaactaacggtccctttacccgtcgtacgttacgctacggtcggtcggacgggtccgggacgtacggggaaacctcgggaccttgaacggngcncggnttcgacgncnncncgcncgcgnncncncnncnncgncncnnncnnncncncnnnnn

SEQ ID NO: 19781 - DNA, 990 bp, Homo sapiens
  misc_feature: GYAE6OF01D41O2.25.86.H09.1.454.CMB.1.raw
tcagactgtacagtcacgaccggtgctcgatttagtgctatagacttgggtttggggggcaggagtcagacccactcaggacacagcatggacatgagggtccccgctcagctcctggggcttctgctgctctggctccaggtgaccaaatgtcgccatccagttcgacccagtcctaccactccctcctgtctcgtcctctgttcgagactatacgtaccacctatctacgttcggtcgggtctacggtcgggtctagttggctagtgtcgtttcgccgtggtactcgacgacgaaacggaaaccggaggggtacgtacctaccgtaacgtccttaccgtagtactttcgtttagtactccgttcccgttaaccgttaagggtttaagggtaaacgggttacggtaccgtacccgtacgtaccggtaacggttacgacggaccggtacgtacggtacggtacgtcgggtaggtactaggttactttacctacttaccctaccaaccgttactaccgaacgtacccgtacggtacccgttacggccgtaaccgtacggttaaacggtaacgttttaccgttaacccgtacgttaaaccctttaaaccgtttttaacgttttaaacggtttaacccggtttaaacctttaaaaaccgggttttaaaaaccgtttttaaaccccgggttttaaaacccctttttcccccccgttttaaccccgggtttttacccccgggttttaacccccgggggggttttaaaccccggggggggtaaaccccgggggggttaaaaacccggggggggtttaaaaacccccggttaaaacgggggggggtttaacgggtaaaaaaccccgggtttaacccgggttaaaaaacccggggttaaaaaacccccgggtttaaacggggttccgggggggttttaaaacccccgtcccgggttttaaaacccccgggcccgttttaaaaaccccggttttccggg

SEQ ID NO: 19782 - DNA, 778 bp, Homo sapiens
  misc_feature: GYAE6OF01BN9MZ.25.86.H09.1.454.CMB.1.raw
  modified_base (734)..(734): a, c, t, g, unknown or other
  misc_feature (734)..(734): n is a, c, g, or t
tcagactgtacagtcacgaccggtgctcgatttagtgctatagacttggggtttggggggagtcagacccactcaggacacagcatggacatggacgggtccccgctcagctccgtggggcttctgctgctcgtggcctcccgaggtgaccaaagtgtcgccactccgtagttcgaccctagtcctcctactccctcccgtgtctcgtcctcgttcgttacgagtactagtactaccacctatcctacgttcggtaccggtcgtacgggtcggtctagttcggactagttcgtcgttacgtcgttagtaagtaacgacgaacggaacggagggactctaccgtaagtcttccgtgtactttacgttagacgtccgtaccgttacggtaaggttaacgggtaaaggtcgtaccgtaacctagtaccggttaaggtaccgaggcgtaacggtaggtcgtacgtacggtacggactagtacttaccgacttcccgactaaccgtacgtaccgacgtaccgacgttccgacgtaccgacgtagtaaccggtacttacgtaaccgggtacctaactttaacgtttacgttaacggttaaccctaaagttaaacccgtttaaagttaccccgtaaacctttccccgtttacgtaacccggttccggttaccggaacgggtaaccggtaggtaaccggtagaaaccgtaaccgtaaagggtaaccgttacggcggggttanacccggtaccgacgtttaaacgttccgttacgtcccgtttaccg

SEQ ID NO: 19783 - DNA, 820 bp, Homo sapiens
  misc_feature: GYAE6OF01A9IM4.25.86.H09.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
tcagactgtacagtcacgaccggtgctcgatttagtgctatagacttggggtttgggggggacacctggggacactgaactggtgctgagttactgagatgagccagccctgcagctgtgtccagcctgcccatcctctgctcatttgcattacttcccaagaaccaccaaccgttcctcgcccctagaacgtactttcgttaaggtacggacttgggtaccacgtactttcttcggacaggactcaacgtacccactacaggaacacgngaccagtacggactacgtacggaccgggtcccncgtacgacgtccgtcggtcgggtccttcgngtccgtgtccgtcgtacggtccgtaccgtagggtacaacccgtaagtccggtacgtaccccgtacgttacccgtacggttacccgaccccgttacggtaccccttaacccgtacgttcccccgtttcctcggttcccttaacgtcccgttttaccgtacggtttaccgaacggtactaacgttccgtacctaaccgtaccgttaccgtacgttacgggttccggtaccgtttcgggtacggttaccgtagtacgggtcttacgttaccggttacgtttaccgggttacgttacggttacgtaccggtaacggtaacccggtaaacgggaaaccgggtacggggtaaaccctaccgggttaacctaacccggttcttaacccgttcggttaaatttccgggtcccgttaacgtaccggtacccgtttacggttagggttaaacggttcggtaaccggtacccttacggtaacgttacgggttaaccgg

SEQ ID NO: 19784 - DNA, 833 bp, Homo sapiens
  misc_feature: GYAE6OF01EYKB0.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccactcctcctgtctgcctcgtgttcgagaccatacgtcaccatctacgttggtcgggctaggtcgggtctagttggcgtagtcgtcgtttacgccgtaggtactacgagacgaacggaaaccgaggggaacgtcctaccgtaacggtcctaccgtaggactttcgtttacggacttcgtaccctttaccgtaagggttttaagggaaacggttcgggtaaccgttccccgaaagttaccggtaaaacgggtttccggaacgggtccgggtaaccggtaagggttacggggtaacggtttacccggggttaacggggtaacccgttaaggttaaaccgtttttcccgaaacgtttccccgtaaccttaaccccggttaagtaccgtaaccggtaccggtaaccgtcccgttaggggaacccctacgggtaacccgttaagggtaaacctacgttttacccgtaacggtaaccttaaaccgttaaagttttcgtaacggttaaacctaaacgtttaaaggtttaacccggttaactttaccccttccggttaaccgttacccggttacggggaaccgggacgggttaaacccgaaggggtttacgaaacgttaggtaaccgaaacggtacgttacgggtcacgtacggacctaccggttta

SEQ ID NO: 19785 - DNA, 617 bp, Homo sapiens
  misc_feature: GYAE6OF01BN4SF.25.86.H09.1.454.CMB.1.raw
  modified_base (172)..(172): a, c, t, g, unknown or other
  misc_feature (172)..(172): n is a, c, g, or t
  modified_base (292)..(292): a, c, t, g, unknown or other
  misc_feature (292)..(292): n is a, c, g, or t
  modified_base (460)..(460): a, c, t, g, unknown or other
  misc_feature (460)..(460): n is a, c, g, or t
  modified_base (491)..(491): a, c, t, g, unknown or other
  misc_feature (491)..(491): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
tcagactgtacagtcacgaccggtgctcgatttagtgctatagacttggggtttgggggcaggagtcagacccactcaggacacagcatggacatgagggtcccccgctcagctcctgggggcttctgctgctctggctcccaggtgccaaatgtgccatccagttgacccngtctcatccctcctgtctgcctctgtcgagacatagtcaccatctacttggtcgggctaggtcgggtctagttggctagtgtctttacgcctggtatcgagacaagaaaccgaggggaancctacctaacggcttccgtagtacttcgtttacgatcgtaccctacgttaggtttagggtaaagttcgggtaccgtcctaacgtacgtaaacgggttcacgggtacggacgtaggtggacgttcgtagggtaacgtagttactttcacttcccactaccactacacgnaacgccgtacgacctacggacctaggaactnttccgactactaacgtttattctatactaattagttaactccttacctcttaccgtccggacggtacgggacggacggtaggtagacgactaacgacgtacgtacgtcggacngtaccngttaccg

SEQ ID NO: 19786 - DNA, 749 bp, Homo sapiens
  misc_feature: GYAE6OF01EUEQD.25.86.H09.1.454.CMB.1.raw
  modified_base (380)..(380): a, c, t, g, unknown or other
  misc_feature (380)..(380): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaactgggtggagtcgtggggagccggtggtacgagggccggggggtccctggacgtactccgtcctggtgtacgcctcgtggtattcattgtttgattgtaatttatcggcctagttcgctacggttcggggtccgtacggaacggggtccgggggtaaggttcgtgggacggtttgggtcttcgtntttagtcgtacgttgggagtggggaagaacgtaacctatagtcgcgtaagtcctagttggtacggaacggttcacttcccaaccgtaccgtacgaagtacgaacaacgactaaccgtaaacgtaaccttacccgttagtaccttacgtacgtaacgtaaaggtcgtaacgtacgttacgtaaccgtaccgtaacctaggtaacgttaaccgtacccgtaacccgttaccgtttaacggtttaatttcggtttacggtagggttaacgggttaaagggttcggggtttaggttaggtaaacgggttacggtaaccggttaccgggtaccccggtaaccccggggtaacccccggtggtacccgtaacccg

SEQ ID NO: 19787 - DNA, 772 bp, Homo sapiens
  misc_feature: GYAE6OF01AMWN7.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctccaggtgccaaatgtgccatccagttgacccagtctccatccctccctgtctgcctctgttcgagacatacgtcaccatcacttgccgggtctaggtcgggtcagttggctagtcgtctttacgcctggtatcgagacaaggaaaccgaggggaacgcctacctaacggccttccgtgtactttctttagacgtcgtcccgttacgtaggttttaacgggaaggttacggggtacctcccgtaagtacgtaaggtttcgaggtccgggacgtagggtcggtacgtacggtacgggtaacctaggttactttacaccttccctaaccgtaacctactacgaacggtcccgaacggtcccgtacgaccgtacggtacccgtaaggttaaacgttacgtttaccggtaaactttaacccgttttaagttacgtttaacgttaaaccgttaaacgtttaaacggtttaaaccggttacccctttaacccgtttcccgttacccgttacccggggtttaaccggggaccggggtaaaccggggttaacggtaacggggttacgggaaaccgttacgaaaccggtaaaacggtacgttacgggttacgggaccttaaccggtcctaccggttatttacccgg

SEQ ID NO: 19788 - DNA, 598 bp, Homo sapiens
  misc_feature: GYAE6OF01BX9TW.25.86.H09.1.454.CMB.1.raw
  modified_base (218)..(218): a, c, t, g, unknown or other
  misc_feature (218)..(218): n is a, c, g, or t
  modified_base (556)..(556): a, c, t, g, unknown or other
  misc_feature (556)..(556): n is a, c, g, or t
  modified_base (560)..(564): a, c, t, g, unknown or other
  misc_feature (560)..(564): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(575): a, c, t, g, unknown or other
  misc_feature (572)..(575): n is a, c, g, or t
  modified_base (577)..(579): a, c, t, g, unknown or other
  misc_feature (577)..(579): n is a, c, g, or t
  modified_base (581)..(582): a, c, t, g, unknown or other
  misc_feature (581)..(582): n is a, c, g, or t
  modified_base (584)..(592): a, c, t, g, unknown or other
  misc_feature (584)..(592): n is a, c, g, or t
  modified_base (594)..(595): a, c, t, g, unknown or other
  misc_feature (594)..(595): n is a, c, g, or t
  modified_base (597)..(598): a, c, t, g, unknown or other
  misc_feature (597)..(598): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgacaaatggacagtctgacacctgatgaccaccgtccttgtattattgtgtagaaggcgtgttgaggtgatgcctcggaccccgngtcagcactacttcacagtgggcgtcgtggggacgaaagggactacggtcactcgtctcctcacgtccctaccgaaccgaacgggcccctaacgttcccggttaccccgtttccccccgcgggtccccgtcccccgtcgtaccctccggaacgggtaccgacccgtacccgtccggaacgacgacccgacgacggccccggcccgtggggacctccggtcccgtagggtaaccaaaccgggtcctttaaaccgttcccgtaacgtcgtaacgtacgttcggtacgggacgggtccggggacgtacggggacaaaccgggcgacgtaactcggatgacncgcnnnnngcngnncnnnncnnncnngnnnnnnnnnanngnn

SEQ ID NO: 19789 - DNA, 578 bp, Homo sapiens
  misc_feature: GYAE6OF01CCMTF.25.86.H09.1.454.CMB.1.raw
  modified_base (190)..(190): a, c, t, g, unknown or other
  misc_feature (190)..(190): n is a, c, g, or t
  modified_base (545)..(578): a, c, t, g, unknown or other
  misc_feature (545)..(578): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgacaaatggacagtctgacacctgatgaccaccgccttgtattattgtgtgaaggnggtgttgaggtgaatcgccgtcggaaccccggcgtcacgcactactctacagtcgggcgtcgtgggggacgaaaggggtctacggctatccgtctcctcacgccctaccaccgaccggccacgttccggttcccttccccgtcggcccggtcccctcgtcccgtaccgaggaccgaccctaaccgtccggaagacccgtacgaaccgaccgggtcccggcccggtcgggacggtttcgccgttacgggacgtaaacggtaccgttaacccttccgtaccgttcgtaaccttagggtcccgtaggggacccgcgggggttccgacgggtaacgggaaccggtccgataacgtcggnnnnnnnnnnnnnnnnnnnnnnnnnnnnnnnnnn

SEQ ID NO: 19790 - DNA, 858 bp, Homo sapiens
  misc_feature: GYAE6OF01CBQS7.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtcgaccaaatgtcgccatcccagttcgacccctagtcctccactcccgtccctggtcctcgccctgttcgttcggagacctatacgtccaacctatcgtacgttcggccggggtctaggtcgggtactagttcggctagtgtccgtttacgtccgtggttactcgaacggaccgaaacgaaaccgggaggggtaacgtcctaaccgtaacgtccttaccgtgtacttcgttacgtacgtccgtacccttacggttaggttaacggaaacggtcggtacgttaccctagtacgtaacgggttacgacggtccggtagtacgggtaggtacgtacggggtacggaacgtacggtttactttaccgtaccttaccccgtacgtaaccccttacgtaccgtaaaccgcccggtaaccgtcccggttagaccggtaccgtaaccgtaggtaacgttaaccgttacccgtacggttaaaccctttaacctttaacggttttaccttaacgggttaaaaccctaaaccggtttttaaacggtttaacccgttaacccccgttttaccccgttaccgttaccccggttcccggggttaaaccggggtaccccggggtaaacgggttaaccggtaaacggggtacggtaacgttaaccggtaaacccgtaaaccgggtacgttcgggtaccgggtacctaaccgtaacccgtcccgtttaaccgg

SEQ ID NO: 19791 - DNA, 895 bp, Homo sapiens
  misc_feature: GYAE6OF01B7X63.25.86.H09.1.454.CMB.1.raw
tcagactgtacagtcacgaccggtgctcgatttagtgctatagactttgggtttgggggcaggagtcagacccactcaggacacagcatggacatgagggtccccgctcagctccgtggggtcttctgctgctcgtggcctcccgaggtcgaccaaattgtcgccagtccgtagttcgacccgagtcctcctactccctcctgtcctcgtccttcgtcgttacgacgaactacgtacgtccacctactctacggtttcggccgggtacttacgggtccggttactagttcggacgtgttcgtacgttttaccgaccggttggtaactaccgaacggaaccgtaaaacggaaaaccgggtaacggggtacctacccgtaaccgtaaaccgtccctttacgtaggttacgtttacgtttacgaccggttccgttacccgttaaccgggtttaagggtttaaacgggtaaccgggttacgggtaccccttaaccgttaacggtaaccggttaaccgggttcggaacggggtaccggtacggtaacggggtaaccgtcggtacggggtaacgggtaacccttacggtttaaacctttaccgacctaccccgttacccaacccgtttacacgtacggccgtaacgtccgacggtacgacggttacctaaggttaactctaccgtacgttaacttactttactaacgtttaactaacgttaacgtttaaacgttacttacccgtttaacccgtttcttaacccccggggttacggttaaccggggtacgggtaaaccgggtacgttaaccgggggtattaaaacccgggttaaacaaaccccgggttaaggttacccggtagggttacccggtacggtacccttaacgtccggtttaaccg

SEQ ID NO: 19792 - DNA, 1199 bp, Homo sapiens
  misc_feature: GYAE6OF01EJB9U.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctccgtggggcttctgctgctctggcctcccaggtgaccaaagtgtcgacctatacctagttcgaccctacgtcctccctactcccttcccgttcgtcctcgtcccttcttggttaccgacgtactacgttaccgtacctaaccctacttacctaaccggttttcgggtacccgggtacgtttacggggttccggggttacttaaggtttcgggaccgttaggttacggtttaccggttttacggtaccggtttacggttaacgttaccggaacggtaaccggtaaaccggggaaaaacccgggtaacggggggtaaaccgttaccccggttaacccgttaaacccggttcccgtttaacccggtttacggtttaccggtttttaccggttttaacggtaacccgtttccggttaaccccgttttaaccggttttaaacggggttttaaacgggttaaaaccggggttacccgggtttaaacccggttaccccgttaaacggtttaaccgggttaaacccgggttacccgggtaaccgggggtaccgggttacgggttaaccgggttaacggggttaccgggtttaccgggggttaaccggggttaaaacccggtttaacgttttaaccggttttaacccctttaaaccccgtttacccccgtaaaccccgtttaaaccccgtaaccggggttccccgaaaccgggtttaccccgaccccgggtttaaccggtttacccccggggaaccgtttaacccggttttaaacccggttaaaaggggtttaaccccctttacccgttttttaacccggtaaacccgggttttaaacccttttaaaacccgttttttaaggtttaaccccggtttttaaaaccgttaaaccccggtttttaaaaacggttttttaaaaccccgggttttaaacccgtttaaccccccttttttaccccccggtttaccgttttaaaccccccgggggtttacccgggggtttaaaccccgggggtaaccggggttaaaacccggggttaaaccccggggttaaagggggtttacccggttaaaaacccggttacccgtaaaaacc

SEQ ID NO: 19793 - DNA, 977 bp, Homo sapiens
  misc_feature: GYAE6OF01AOXL2.25.86.H09.1.454.CMB.1.raw
  modified_base (616)..(616): a, c, t, g, unknown or other
  misc_feature (616)..(616): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctcgtggcctcccgaggtcgacctaaagtgtcgccctataccgtaggttcgacccctagtcctcccgacttcccgtcccttgtctcgtccttcttcggttcgacgacctagtacgtccacctactccacgtttgggccgggtctacgggttccgggtactagttcggcgtacggtcggttacttttacggtccgttggttactccgtaacgaccgaaacgggtaaacccgggtaacgggggaacgtacccttaacccgtaacggtcccttccgtaggttaaccgttcgttttacgtacgttaccgttccttaccggttaaaggtttaacggtaaacggttcgggtaaccgttaccttaacggtacggttaaacgggttacgaccggggtacgggtacgttacgggtacggttacggttacgggttaaccggggtaacgtacggtttacctttacccggtaacctttccccgtaacccgtaaacccgtntacccgggtaacgtacccggtaaccggttcccgtacccggggtaacccgtacgggttaaccggtaaaccggtttaaacgtttcccggtttttaaacccgcccgtttaaaccctttaaacccggttttaatttttaaccggtacccgtttaaacgtttaaaaccggtttaaaccggttttacccggtttaaaacccctttcccccggttaccttttacccgggttaccccggggttacgggtaaaacccggggttaacccggggtaaacgggttagggtaacgtaaaccgtaaaccggttaaaccgtaaaccggttgttaaccgggtcgttaccccggtactaaaccgttccgtttaaccgg

SEQ ID NO: 19794 - DNA, 513 bp, Homo sapiens
  misc_feature: GYAE6OF01B74PM.25.86.H09.1.454.CMB.1.raw
  modified_base (482)..(482): a, c, t, g, unknown or other
  misc_feature (482)..(482): n is a, c, g, or t
  modified_base (484)..(513): a, c, t, g, unknown or other
  misc_feature (484)..(513): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgaccaccgccttgtattattgtgtgaaaggcggtgttgaggtgaatgcctcggaacccccgcggtcagcactacttctacagtgggcgtcgtggggacgaaagggactacggtcactccgtctcctcacgccctaccaaccgacgggccccagtccggttcccttcccccgtggcccgccctcgccgtccgaggacgccacccgtccgagacgcaacgcgccggccctggggcctcgcccgtggtaccaacgggtaccttaccttccacgtcgtaccagtcgtggacggcgggcgtcgggacgaacgggccacgatagcagctncnnnnnnnnnnnnnnnnnnnnnnnnnnnnnn

SEQ ID NO: 19795 - DNA, 505 bp, Homo sapiens
  misc_feature: GYAE6OF01B1PR3.25.86.H09.1.454.CMB.1.raw
  modified_base (428)..(428): a, c, t, g, unknown or other
  misc_feature (428)..(428): n is a, c, g, or t
  modified_base (478)..(505): a, c, t, g, unknown or other
  misc_feature (478)..(505): n is a, c, g, or t
tcagactgtacagtcacgaccggtgctcgatttagtgctatagacttgggtttgggagaagaacctactatgcagactctgtgaaggtcgattcaccacctccagagacaacatcaagaactccctgtatctgacaaatggacagtctgacacctgatgacaccgccttgtattattgtgtgaaaggcggtgttgaggtgaatcgcctcggaacccccgcggtcagccacgtacttctacgatgggcgtcgtggggcaaagggctacggtcagtcgtctcctcacgcctccaccgacgggcccagtccgtccttcccccgtggccgccctgcctccgaggcgcaccctccgagacgacaccgagcccggcccgtgggtcctcgtcccgtggtaccaacggtaccttaccttcccacttacggtaaccncggtcgtgggacggccgggtacgtcgggaccgagggcgacctaatcgacnnnnnnnnnnnnnnnnnnnnnnnnnnnn

SEQ ID NO: 19796 - DNA, 686 bp, Homo sapiens
  misc_feature: GYAE6OF01A2G5O.25.86.H09.1.454.CMB.1.raw
  modified_base (148)..(148): a, c, t, g, unknown or other
  misc_feature (148)..(148): n is a, c, g, or t
  modified_base (229)..(229): a, c, t, g, unknown or other
  misc_feature (229)..(229): n is a, c, g, or t
  modified_base (417)..(417): a, c, t, g, unknown or other
  misc_feature (417)..(417): n is a, c, g, or t
  modified_base (471)..(471): a, c, t, g, unknown or other
  misc_feature (471)..(471): n is a, c, g, or t
tcagactgtacagtcacgaccggtgctcgatttagtgctatagacttgggtttgggggcaggagtcagacccactcgagggacacagcagtggacagtgacgggtccccgctcagcctccgtggggcttcgtgctgctctggctccgnggtcgaccaatgtcaccactcctagttccacctcgtcctcctctccctccgtgtctcgtcctcgtcgtcgacgctacgtancctactactctacgttcggcggtcgttagtcggtctagttgcgtgtcgtcttaggtcttggtactcacggtacaacggaacggacggacgctaccgtacggtctcgtctgttctacggttctaccgtcgttacgttaggtacggtaacgtcgtaccgtactagtaccgtagttcgagtcgagacggtnacggtacgaggtactaggttacctcgtactctacgacttaacgcgtaacggtcnccgtcgtaacgtcgtacaacgtggtactgtctacgtacttaactcttaccggttaataacgttaacgtttaaacgttactttaacctttacccgttacggtaccgttccgggtaccgggtaggggtaaacccggtacgggtaacgttaagggaacgttaacctacggtaaaaccgttcgacggttaaccgtcggtaacctcgtaccgtttaccgg

SEQ ID NO: 19797 - DNA, 708 bp, Homo sapiens
  misc_feature: GYAE6OF01D4CPF.25.86.H09.1.454.CMB.1.raw
  modified_base (107)..(107): a, c, t, g, unknown or other
  misc_feature (107)..(107): n is a, c, g, or t
  modified_base (145)..(145): a, c, t, g, unknown or other
  misc_feature (145)..(145): n is a, c, g, or t
tcagactgtacagtcacgaccggtgctcgatttagtgctatagacttggggtttgggggcaggagtcagacccactcaggacacagcatggacatgagggtccccgntcagctcctggggcttctgctgctctggctcccaggtnaccaaatgtcgcccatccgagttcgaccccagtcctcctactccctccctgtcctcgcctctgtcgatactatacgtcaccatctacttggtcgggtctaggtccgggtcagttcggactagtcgtactttacgcccttggtaactccgagacaaacgaaaccgaagggggactaccgttacctaacggtcctacccgttgtacttcgtttagactcgtacctaccgtaggtttaggaaacgtcggaccttacccaatacggtaacggttcgacggtccggtatacggtaggactccggagggtaactaaggttacctttacgaccttccctacaaccctagtcacggactcgaactgaccgcgtaccctaggaaaccgtctcggtactaccgtaacttattactcgtaaacctaaagttaacttaacgtccttaacctcccgttacccgttaccggttaccgggaccggaaacgggttaccgtaaacgggttacgggaactaactaaaccggtaaaccggtaaacggttacctggtaccctaacggccctaaccgttacccg

SEQ ID NO: 19798 - DNA, 917 bp, Homo sapiens
  misc_feature: GYAE6OF01EKEAH.25.86.H09.1.454.CMB.1.raw
tcagactgtacagtcacgaccggtgctcgatttagtgctatagacttgggtttggggggacacctggggacactgaactggtgctgagttactgagatgagccagccctgcagctgtgtccagccctgcccatccctctgctctatttgctattacttcccaagaaaccacctaaccttccgtcgcccctagaaacgtcctttcgttaggtacggtcgttcggtacctaaccttacgtttcgttaggaccgtaagggtaccgtaccaaccggaacccctacgtaccgaacggaaccacgaggtacctaaggtacggaacgtacggttaccgggacccggggttcccccgtacgtccgaccggtccgttccgggtcggggtccttcgtcgtccgtcggtccgttcggtccggtacccctaccgggtacggtaccgtaaccgtaagttcgtaccgacctacttaccgtacggttacccgaacccgtcgttccctaccctccttccccttccgttcgttccgttaccgtcccgtttgtccgttaacggaactaccgttaactacccgttaccctaaccgttcgttaccgttacggtttaccgggtcccgggttacggttacggggtttccggttaacgttcgggtttacggtccgttaacgggttttccgttaccggtttttacggccggttttaagggtaccgtaacggtaaccgggaacggtaaaccggggttaaaccgggtaacggggtaacccttaccgttaaccggtttacgtacccgttacgtttacggttacttttaccgttacggtacccgtttacccggttacggtttaaaccggggtttagggtttaaaccggggtaaacgtttccgggtaaacccttttcccggtaaagggttaacggttaacccgggg

SEQ ID NO: 19799 - DNA, 882 bp, Homo sapiens
  misc_feature: GYAE6OF01E14TM.25.86.H09.1.454.CMB.1.raw
  modified_base (854)..(854): a, c, t, g, unknown or other
  misc_feature (854)..(854): n is a, c, g, or t
  modified_base (866)..(866): a, c, t, g, unknown or other
  misc_feature (866)..(866): n is a, c, g, or t
tcagactgtacagtcacgaccggtgctcgatttagtgctatagacgttggggtttggggggagtcagacccactcaggacacagcatggacatgagggtccccgctcagcctccgtggggccttctcgctcgctcgtcggcctcccgaggtcgaccctaaagttcggtcgaccctacgttacccgtaacgttccgaccccgtagttccctccctaccttcccccttcccgttggttccgtccgtacccgttccgttacgtttaccgaacggtactaacgttaccgtacccaaccgtacttaccgtacggtttcgggtaccgggtcgttaacgggttccgggttactaggttcggactaggttcgttcgttacgccgtagtactgacgtacgaacggaaaccggagggtacctaccgttaaccgtaacgtcccttacgttcgtaacgtttcgttacgtaccgtccgtcccgttaacggtttaggttaacggtaacggttaccgtaccgtacccgtaagttaccggtaacggtcgacggggtccggtacgtacgggtacgttacggtaccgggtaacggtaccttaacggtttacttccgaccctttcccgaacgtacctacgtaccacgtacgtacccgtcgtacggtaccgtacggtacgtacgtaactttccgtcaaccgtttaaccttacttttaagttaccggtaactaacgttaaaactttaacggtttaaccgttaccctttccccgtagtttaccccggttacccggggtcggggaaaccgggttaccggaacggtaagggacgtaaccgtaaacggtaccggtaaacgttcggtacgtccggtaacncccgtaaccctnttccgtttcgtacccg

SEQ ID NO: 19800 - DNA, 598 bp, Homo sapiens
  misc_feature: GYAE6OF01B56VV.25.86.H09.1.454.CMB.1.raw
  modified_base (219)..(219): a, c, t, g, unknown or other
  misc_feature (219)..(219): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (556)..(558): a, c, t, g, unknown or other
  misc_feature (556)..(558): n is a, c, g, or t
  modified_base (560)..(560): a, c, t, g, unknown or other
  misc_feature (560)..(560): n is a, c, g, or t
  modified_base (562)..(566): a, c, t, g, unknown or other
  misc_feature (562)..(566): n is a, c, g, or t
  modified_base (569)..(569): a, c, t, g, unknown or other
  misc_feature (569)..(569): n is a, c, g, or t
  modified_base (571)..(573): a, c, t, g, unknown or other
  misc_feature (571)..(573): n is a, c, g, or t
  modified_base (575)..(576): a, c, t, g, unknown or other
  misc_feature (575)..(576): n is a, c, g, or t
  modified_base (578)..(580): a, c, t, g, unknown or other
  misc_feature (578)..(580): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(592): a, c, t, g, unknown or other
  misc_feature (587)..(592): n is a, c, g, or t
  modified_base (594)..(595): a, c, t, g, unknown or other
  misc_feature (594)..(595): n is a, c, g, or t
  modified_base (597)..(598): a, c, t, g, unknown or other
  misc_feature (597)..(598): n is a, c, g, or t
tcagactgtacagtcacgaccggtgctcgatttagtgctatagacttgggtttgggagaagaacctactatgcagactctgtgaagggtcgattcaccacctccagagacaacatcaaagaactccctgtatctgcaaatggacagtctgacacctgatgacaccgcttgtattattgtgtgaaaggcggtgttgaggtgaatcgcctcggaaccccgngtcagcacttactctacgatgggcgtcgtgggacaaacgggactacggtcagtccgtctacctcgacgccctaccgaccgtaacgggacccctagttcccggttacctttccccccgtcgggacccgtcccctggtaacccgttccgaacgggaacgaccctaccccgtaccggaacgacgccaaccgtacggcccggtcccgtggggcccttacggcccgttacggggtacgtacccgtttaaccttcccgtaaacgtcgttaaactccggttacgtacggacgggtcccgggagtacggaccgtaaaacggggcctaactaaggtagcntanagnnnancnnnnnganannntnnannnagnancnnnnnnanngnn

SEQ ID NO: 19801 - DNA, 574 bp, Homo sapiens
  misc_feature: GYAE6OF01B384I.25.86.H09.1.454.CMB.1.raw
  modified_base (207)..(207): a, c, t, g, unknown or other
  misc_feature (207)..(207): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (547)..(547): a, c, t, g, unknown or other
  misc_feature (547)..(547): n is a, c, g, or t
  modified_base (549)..(551): a, c, t, g, unknown or other
  misc_feature (549)..(551): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (560)..(574): a, c, t, g, unknown or other
  misc_feature (560)..(574): n is a, c, g, or t
tcagactgtacagtcacgaccggtgctcgatttagtgctatagacttgggttggagaagaacctactatgcagactctgtgaagggtcgattcaccacctccagagacaacatcaagaactccctgtatctgcaaatggacagtctgacactgatgaccaccgtccttagtattagttagtgtaggaaaagggtcgtagttgaggtnaagtcggcctaccgggaacccccgtggtcagacctactttaccgtctacagtggggaccgttcgtggggacaaagggtacctacggtcacgtctcgtcctacncgcctaccacgaccggcctagcccggtcctccctaggcccgcctgtacctcgaacgcgtaccnccgtaccgagaacgaccaaccgcggtcccggccgttgggtcctcggtacccgtcggtaaccgaacggtacctttacccgtccgtacgttacgacggtacgttacgaggaccggtacgggacgttacggacgtacggaccgtagactaaggcatgcncncngtcgcgnanngtanannnancnngnannnnnnnnnnnnnnn

SEQ ID NO: 19802 - DNA, 842 bp, Homo sapiens
  misc_feature: GYAE6OF01AEG41.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctagctctggctcccaggtcgccaaatgtgccatccagttcgacccagtctccactccctcctgtctcgtcctcgtgttcgacgacatacgtccacctactccgtacttcgggccggtcgttacggtccgggtatacgtttacggctacggtgtcgtttaacggccggttcggttactacgtacggtacgaaacggaaaccggtaacgggggtaactccgtaaccgttaacggacccttccgtacgtaacgtttccgtttacggtaactcggtaccccttaccggttaagggtttaacgggaaacggttcggtaaccgtaccgtacgttaccggttaacggttacgacggtaccggtacgtacgggttacggtacgttacgggtacggtaacgtaacgttacgtttaccgtaacccgtttacctaccccgaaacgttaccgttacgacccggtactaaccggttcccaccgggttaccgacgggtaccttaaacgggaccgttagtttcccgtaacgtaccgtttaaaccgtattttaccggttaacgaactttaaaaccgttacggtttaacgtccccttttacccgtacgttaccccgttacgggttacccgggtacccggggtaaacgtacccgggttagggaacgttaaccgaaccgttaaacccgggtaacctggttacggttagacccccgtgtaacctacccggttacgg

SEQ ID NO: 19803 - DNA, 822 bp, Homo sapiens
  misc_feature: GYAE6OF01DAJ1I.25.86.H09.1.454.CMB.1.raw
  modified_base (125)..(125): a, c, t, g, unknown or other
  misc_feature (125)..(125): n is a, c, g, or t
  modified_base (399)..(399): a, c, t, g, unknown or other
  misc_feature (399)..(399): n is a, c, g, or t
tcagactgtacagtcacgaccggtgctcgatttagtgctatagacttgggtttgggggcaggagtcagacccactcaggacacagcatggacatgagggtccccgctcagctccgtggggcttcngctgctctcggctcccagtcgccaaatgtagccatccgtagtttcgaacccgtagtcctacctacttccctcccttgtcctcggtcccttcgtcgttacgacgtacctattacgacctaacctactacgtaaccgtttcggtaccgggacttaacggtaccgggtcttaaggtttcgggactacggttcgttacctttacggccgttaggtaactacgacgtaccgaaacgaaaccggaggggtacttaccgtacctaacgtccgttaacgttntaaccgtttcgttacggtacttaccggttaccttaccggttaagggtttaggaaacggttccggtacgtaccgttaacgtcgtaaaccggttacaacgggtacgtaacggttacggacggttacgtaccggtacggaaactacggtttacttcgtaaccgtacctacggtaacccattacccgggtagtacccgtacgggtaccctacggtaccgtaacgtacctacggttaaagtcccgttaaccggtaaccgtacgtttaaaccttaggtttaacgaacttaaacgttaaacgtaacgtttacgtacccttttaccgacccttaccggtacgttaaccgggacgtaaacgtaaccgggagttacccgaagttacccggaaacgtaccgtcgttacggaacgttcgccaaacggtccttacg

SEQ ID NO: 19804 - DNA, 1028 bp, Homo sapiens
  misc_feature: GYAE6OF01EQ222.25.86.H09.1.454.CMB.1.raw
  modified_base (187)..(187): a, c, t, g, unknown or other
  misc_feature (187)..(187): n is a, c, g, or t
tcagactgtacagtcacgaccggtgctcgatttagtgctatagacttgggtttgggggcaggagtcagacccactcaggacacagcatggacatgagggtccccgctcagctcctgggcttctgctgctctggctcccaggtgccaaatgtgccatccagttgacccagtctccatcctcctgtctncctctgttcgagactagtacgtaccaccgtatcctactttcggtaccgggtcttaggtccgggtacaagtttgggctaggtcgtacgtttacgccgtggtatcagacaacggtaaaccggaggggtaactccgtaccgtaacgtccttaccgtaggtactttccggttgtacgtacgtccctttaacggtaggttttacggaaacgttcggtaaccgttaccctaaacgttacgtaaacgggttacgacgggtaccgggtacgtaacgggttacgggtaacgtacgggtacggggtaacttaaacggtttaacttttaccgtaaccgttaccccgtaacccgtaacccgtacgttaacccgtaaacggggtccctaccggggttaaccccttacgggaaacccgttaaccgggttacccgttaaaagggtaaacccggttttaaccgtttttaacccggggttaacccggtttaaaacccctttaaaaccgggttttttaaaccggttttaacccgttttttaaaccgggggtttaaacccttaaaaaaccggtttttaaaccgggtttttttaaaacccgggggttaaaccccctttttacccccggtttttaaaccccggtttccccgggttttaaacccccggggttaccccgggggggtaaaaacccgggggtttaaaacccggggggtaaaaaccccgttaaggggggtttaaacccggggttaaaacccggttaaccggtttaaaacccggaaaaaccccggggtttaacccggtaacgggggtttcgttaacccgtacccccggggttaaactaaaccccgggttttaacccgg

SEQ ID NO: 19805 - DNA, 757 bp, Homo sapiens
  misc_feature: GYAE6OF01BY6J8.25.86.H09.1.454.CMB.1.raw
  modified_base (216)..(216): a, c, t, g, unknown or other
  misc_feature (216)..(216): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctcggcctcccgaggtcgacctaaagtgtgcccaatccagttcgacccagtcctccactcctccctgtctgcctcgtgtcgagacntacgtcacctatctacgttggtcgggacttacggtcgggtctagttcggcgtagtgtacctttagccgtggtactcgagacaacggaaccggagggaactcctaccgtaacgtcctaccgtgtacgttcgttagcgttacgccgttacgttaggttaggaacgtcggtaccgtacgtacgtacggtaacgtcggacgcggtacgagtacggtactcggacgtagtacgttactccgtactccgtacacgtatcaacggtccgtactcgtacgacgtacgtacgtaggtaacgttactaccgtaccgtaacttactttaacgttagttaaccgttaaccgtaaaacgttaacgtttaaccctttaaccggtaaccctttccggttaccccggttacccggggttaacgggtacccggggtaaaacgtacccgggggttaaacgggtacggttaaaacccggtaacggtaaaacccggttaaaggttaccggttaccgggggttacccaagggttacccctaaaccggtaaccgtttacccgg

SEQ ID NO: 19806 - DNA, 697 bp, Homo sapiens
  misc_feature: GYAE6OF01BJ6ZX.25.86.H09.1.454.CMB.1.raw
  modified_base (474)..(474): a, c, t, g, unknown or other
  misc_feature (474)..(474): n is a, c, g, or t
  modified_base (652)..(654): a, c, t, g, unknown or other
  misc_feature (652)..(654): n is a, c, g, or t
  modified_base (657)..(657): a, c, t, g, unknown or other
  misc_feature (657)..(657): n is a, c, g, or t
  modified_base (659)..(661): a, c, t, g, unknown or other
  misc_feature (659)..(661): n is a, c, g, or t
  modified_base (663)..(663): a, c, t, g, unknown or other
  misc_feature (663)..(663): n is a, c, g, or t
  modified_base (665)..(666): a, c, t, g, unknown or other
  misc_feature (665)..(666): n is a, c, g, or t
  modified_base (668)..(674): a, c, t, g, unknown or other
  misc_feature (668)..(674): n is a, c, g, or t
  modified_base (676)..(678): a, c, t, g, unknown or other
  misc_feature (676)..(678): n is a, c, g, or t
  modified_base (680)..(681): a, c, t, g, unknown or other
  misc_feature (680)..(681): n is a, c, g, or t
  modified_base (683)..(684): a, c, t, g, unknown or other
  misc_feature (683)..(684): n is a, c, g, or t
  modified_base (686)..(688): a, c, t, g, unknown or other
  misc_feature (686)..(688): n is a, c, g, or t
  modified_base (690)..(692): a, c, t, g, unknown or other
  misc_feature (690)..(692): n is a, c, g, or t
  modified_base (694)..(694): a, c, t, g, unknown or other
  misc_feature (694)..(694): n is a, c, g, or t
  modified_base (696)..(697): a, c, t, g, unknown or other
  misc_feature (696)..(697): n is a, c, g, or t
tcagactgtacagtcacgaccggtgctcgatttagtgctatagacttgggtttggggagaagaacctacatgcagactctgtgaaggtcgatcaccacctccagagacaacatcaaagaacctcctgtatctcgacaaagtcggaacacgttactacggaaccaaccgtggacttacgaacccacccggttcctttagttaactttagttggtaggtaggaaacgggtcgggttggttaggacggtagtaacgtccggacccggttacccgggaacccccggtcggtaccgacgtaccctaaaccgtttaccttaccgtaccgtagggttcgggtcggtacgggtacggggaacgtaaaacggggtcctacgggtactaacgttccgtccttcctaccaccgtcccctaccgaaaccgacggggtaccccttacgtcccggtttccccgttaccccgtcggcccttacccgtcnccggtaccgaacggtcccaccctaccggacgacgaacgacccgacgccggttccggaccggtcgggtcgtaccgtccgttaacgggtaccgtaaccgttacctttacctaccgtacgttacgtaacttcgggcgttacggccgggcggttccggagtaacccggtagctactagacgnnngcngnnngncnngnnnnnnncnnngnncnncnnncnnncngnn

SEQ ID NO: 19807 - DNA, 556 bp, Homo sapiens
  misc_feature: GYAE6OF01A3JJ2.25.86.H09.1.454.CMB.1.raw
  modified_base (148)..(148): a, c, t, g, unknown or other
  misc_feature (148)..(148): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (512)..(512): a, c, t, g, unknown or other
  misc_feature (512)..(512): n is a, c, g, or t
  modified_base (534)..(556): a, c, t, g, unknown or other
  misc_feature (534)..(556): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggacagtntgacacctgatgaccaccgcctttgtatttattgtgtgaaggtcggtgtgaggtnatgcctacggacccgngtcagcactacttctacagtgggcgttcgnggggaacaaaggactacgggtcactccgtcctccgtcacgtccctaccgacccgtaacggccccgttacgttccccgggtttcccttaccccccggtggccccgtccccttggccctacggacggtacgcccgtaccgtacccgagcgtaaccgacgtacggcccggaccggtcgggacctcggtccgtgggtaaccgacgttaccgtaccgttaccctaacgttcggtaacgtccgttcgttcgggaccgggcgggtaccgngtacggaaagccgtagacgtannnnnnnnnnnnnnnnnnnnnnn

SEQ ID NO: 19808 - DNA, 688 bp, Homo sapiens
  misc_feature: GYAE6OF01AB9XQ.25.86.H09.1.454.CMB.1.raw
  modified_base (530)..(530): a, c, t, g, unknown or other
  misc_feature (530)..(530): n is a, c, g, or t
tcagactgtacagtcacgaccggtgctcgatttagtgctatagacgttgggtttgggggcaggagtcagacccactcaggacacagcatggacatgagggtccccgctcagctcctggggcttctgctgctctggcctcccaggtgccaaatgtcgcccatccgagttacgacccagtcctccacttccctcccttgtctcgtcctcgtgtcgagacatacgtccaccatcgtacgttggccggtcgttacggtccgggtatagttgggctagttcgtctttacggccgttaggtactccgagacaacggaaaccggaggggatccgtacctacgctccgtagtattcgtttcgattccgtcccgtcgttaagggtttacggaacgggtcggtaccgtacccgtagttacgaacgggttcgacgggcgttacgaggttacggtacgtcggtaggtaactacgttaccttccgaccttcctacccacgtaatccggactccgacggtctacgtcgactcgtaagaccgttntccgtagtaccttaacttacttgtaacgtaacctaaagttaaccggttattaccccttcgtaccgttcgtccggtacggggacgggaccgacggttagggtcaaccgtacaacccggtaaattcgggtacggttacgaccgtacgtcctagttacccg

SEQ ID NO: 19809 - DNA, 734 bp, Homo sapiens
  misc_feature: GYAE6OF01E2HUB.25.86.H09.1.454.CMB.1.raw
tcagactgtacagtcacgaccggtgctcgatttagtgctatagacttggggtttgggggggagtcagacccactcaggacacagcatggacatgagggtccccgctcagctcctggggcttctgctgctctggctcccaggtgccaaatgtgccatccagttcgacccagtctccatccctccctgtctgcctctgttaccgagacatacgtcaccacttctacgttggtccgggcttacggtccgggtctagtttggaccgagttcgtctttacgccttgggttactcacggacaacggaaaccgaggggaacgtcctaccgtaacgccttccgtagtactttcgtttagactccgtaccttaccggttaaggtttacggaaacgggtcggtaacctacccctataccgtaaggttccgaggccggtacgagggtacggtactacggtggaccgtagttacctttcgaaccttccctacctaaccagttacccgacgttacgaccgtccggtacgaccgtaccggtaccgtaggaactttaaccgttccgtaacgttacccttaaacgtttaactttacgttaacgtaacctaaagttaaacggtttaacgttacccttacccgttcttaccgttaccggtcccgggtaagggaccggtaccgaagggtcgtaacgtacggaactaacgacggttacgtcggaaccttcgaacccgtaccgtgttcccgttcg

SEQ ID NO: 19810 - DNA, 853 bp, Homo sapiens
  misc_feature: GYAE6OF01EO8PV.25.86.H09.1.454.CMB.1.raw
  modified_base (737)..(737): a, c, t, g, unknown or other
  misc_feature (737)..(737): n is a, c, g, or t
  modified_base (747)..(747): a, c, t, g, unknown or other
  misc_feature (747)..(747): n is a, c, g, or t
  modified_base (798)..(798): a, c, t, g, unknown or other
  misc_feature (798)..(798): n is a, c, g, or t
  modified_base (810)..(810): a, c, t, g, unknown or other
  misc_feature (810)..(810): n is a, c, g, or t
  modified_base (823)..(823): a, c, t, g, unknown or other
  misc_feature (823)..(823): n is a, c, g, or t
  modified_base (830)..(830): a, c, t, g, unknown or other
  misc_feature (830)..(830): n is a, c, g, or t
  modified_base (841)..(841): a, c, t, g, unknown or other
  misc_feature (841)..(841): n is a, c, g, or t
tcagactgtacagtcacgaccggtgctcgattttagtgctatagacttggggtttgggagaagaacctactatgcagactcgtgtgaagggtcgattcaccacctccagagacaacatcaagaacctccctgtatctgacaaagtggactagttctgactacctgtactcgactaccgtctttcgttattacgttgtgtaggtaagggtcgggttggttggagggtcgaacgtcggccgttaccgggaacccccggtggtaccacggtcaacctttacgttactaacgaggtcgggtacgtcgtaggggacgtaaacggtacttaccggtacacgttccgtccttaccgtacgaccggtccctaaccggaaccccgtaaccggggtacccctaacgttccccgggtttacccgtttccccccggtcggggtacccggtccccggttcggtaaccccggttaccgggaaacgggtccccttacccgggttaaccccgttaccgggaaccggtaacggacccgtaaccgggtaaccgggtacccggtacccggtaggggttcccgttaaccgggtaccccggttaacgggaaccgtttaaaccgggtaacccctttaacccgggtttccctaaaacggtttaccccggtattaacccgggttaccggtaaccgggtacgggaaccggggttacgtaacgggtaacccggtaaaggtaccggtactagtaacggtctacnttaccgaganaccgtgactgtcggacagtaacgtcagttcaagcgtaagtaggtacaggtnaaggttcccaancgttaagccggtnttaagtnaacccgtttcnggttcaaccggg

SEQ ID NO: 19811 - DNA, 586 bp, Homo sapiens
  misc_feature: GYAE6OF01ERX7G.25.86.H09.1.454.CMB.1.raw
  modified_base (130)..(130): a, c, t, g, unknown or other
  misc_feature (130)..(130): n is a, c, g, or t
  modified_base (132)..(132): a, c, t, g, unknown or other
  misc_feature (132)..(132): n is a, c, g, or t
  modified_base (160)..(160): a, c, t, g, unknown or other
  misc_feature (160)..(160): n is a, c, g, or t
  modified_base (235)..(235): a, c, t, g, unknown or other
  misc_feature (235)..(235): n is a, c, g, or t
  modified_base (449)..(449): a, c, t, g, unknown or other
  misc_feature (449)..(449): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagactgtacagtcacgaccggtgctcgatttagtgctatagacttgggtttgggagaagaacctactatgcagactctgtgaagggtcgatcacacctccagagacaacatcaagaactccctgtatntncaaatggacagtctgacacctgatgacnccgcttgtattatgtgtgaaaggtcgtgttgaggtgaatgcctacggaaccccgtgtcaggcactacttctaacntcgggcgtacgtggggacaaagggtctacgggtcagttcgtctcctcaccgcctccgaaccgaagggcccctaatccggttaccttcccccgtgggcccgtacccttcggcctccgaacggactccaccgtcgacgacgcctaacgacggcgcccgtagggcctgccgtaggacgtaaacggtacctaccttccgactacggtacacggttacncggtacgcgggcgtagggacccagggttacntaacgtaagcgtcagcagtcngatcagtccgancgtagcgctagactagngtacngtaccncgtacgtgtacgtcgactagacgtcgacgtactacgtagtcgacg

SEQ ID NO: 19812 - DNA, 755 bp, Homo sapiens
  misc_feature: GYAE6OF01B24UD.25.86.H09.1.454.CMB.1.raw
  modified_base (331)..(331): a, c, t, g, unknown or other
  misc_feature (331)..(331): n is a, c, g, or t
  modified_base (503)..(503): a, c, t, g, unknown or other
  misc_feature (503)..(503): n is a, c, g, or t
tcagactgtacagtcacgaccggtgctcgatttagtgctatagacttggggtttgggggcaggagtcagacccactcaggacacagcatggacatgagggtccccgctcagcctcctggggcttctgctgctctcggctcccaggtgaccaaattgtgccatcctagttcgaccctagtcctcccatccctcctgtcctcgtccttcgtgttcgagacatacgtccaccattctacgttggtccgggtacgttaggtcgggtacctaggttcggcgtagtcgtcttttacggcccttaggtactcaggacaacggaaaccggagggggacnccgtcctaacgtcccttctgtacgttcgtttacgtacgtcggtacccttacggtaggttttaggaacgtcggtaccgttacccgagttacgtaaggttcgacggtcggtagacggtaggcgttacggtagggtacaggtttacttctaaccgttcccgtaccaacccgttanaccgtagtcccgaacgtccgtagtacccgtaagtcccggtaagaacgtttcttaccgtactaccgttaactttaagtttacctaattaaccgttaaactttaacgttttaacccggtacctttaccccgttacgttacccggttccggtaacgggtacccggggtaacgggtacccgttaaggggtaccaaacgggtactaaacggaaacggtaccgttaggttacggacccttcgaccgtacccttaacgg

SEQ ID NO: 19813 - DNA, 806 bp, Homo sapiens
  misc_feature: GYAE6OF01CIHRT.25.86.H09.1.454.CMB.1.raw
  modified_base (104)..(104): a, c, t, g, unknown or other
  misc_feature (104)..(104): n is a, c, g, or t
  modified_base (131)..(131): a, c, t, g, unknown or other
  misc_feature (131)..(131): n is a, c, g, or t
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (755)..(755): a, c, t, g, unknown or other
  misc_feature (755)..(755): n is a, c, g, or t
  modified_base (799)..(799): a, c, t, g, unknown or other
  misc_feature (799)..(799): n is a, c, g, or t
tcagactgtacagtcacgaccggtgctcgatttagtgctatagacttgggttggggcagggagtcagaccactcaggacacagcatggacatgagggtccccgntcagctcctggggcttctgctgctcgnggctcccgaggtgacctaaatggtcnccatccagttcgaccagtctacnctcctcctgccgtcgcctntcgtacgagtacatacgcaccgatccgagttggtcgggcttacgggtcggtactagttggactaggtcgtacgtttacgccgttaggtatcgacgacgaacggtaaacgacggggaactccgtacgtaacggtctccgtacgtcgttacgttacggacgtccgtaccctaccggttaagggttttacggaaaggttccgggtaaccgtaccgttaacgtaccgtaaagggtttcccggaaggtaccgggtaccgttaagggacggtacgttaccgggtacggtaacgtaccggtttaaacgtttcccgtaaaccttccccggtaactaaaccgtacgttaccgaacgtaaccgggtccgtaccgtaacgggtaccctacgggtaaccggtttaacgaaacggtttacgttaacgttaccggtaaaccgttaaaccgttaagtttacgttaaacggttaaacctaaacggtttaaggttaaaccggttacctttaacccgttccgtaccggtttaccggttacgggaaacgggttaacgggaaccgtaaggggttanaacggtaacgtaacccgtaagacggttggaacgtcgaacgtccngttaccg

SEQ ID NO: 19814 - DNA, 591 bp, Homo sapiens
  misc_feature: GYAE6OF01AHQLP.25.86.H09.1.454.CMB.1.raw
  modified_base (197)..(197): a, c, t, g, unknown or other
  misc_feature (197)..(197): n is a, c, g, or t
  modified_base (559)..(591): a, c, t, g, unknown or other
  misc_feature (559)..(591): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacacgtccttgtattattgtgtgaaaggtcggtgttgnggtgaatcgccgtccggaacccccgcggtcaggcacttacttctacagtcgggcgttcggaggggacgaaagggaccgtacggctacgtcgtcctcctccacgccctacccaaccgaaccggtcccctacgtcccggttcccctttccccgcggccgtcccctcggtaccctaccgaggtaccgccctacccgtaccgacggaacgcccgtaaacgcggccccggtccggtcggcgtaccggtccccgtaggtaccgtaaacgggttacccttaccgttaccctagttaccggtacgtacggttccggtacgggtacgggccgggttcggcgggaacgaacgggcccgtacgtaaagcggtnnnnnnnnnnnnnnnnnnnnnnnnnnnnnnnnn

SEQ ID NO: 19815 - DNA, 484 bp, Homo sapiens
  misc_feature: GYAE6OF02FV8W9.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatcttgatgcctcagttgaagtggatccatcaaggttcagcgcagtgatctgggacagatttcatcctcaccatcagcagcctgcagcctgaagattctgctaaccttattattgtacaaactaatttaagacttaccctctctccttcggcggaggaccaaggtgagatacaaacgactgtggctgcacta

SEQ ID NO: 19816 - DNA, 521 bp, Homo sapiens
  misc_feature: GYAE6OF02HGCCE.25.86.H09.1.454.CMB.1.raw
  modified_base (405)..(405): a, c, t, g, unknown or other
  misc_feature (405)..(405): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagtatttcatcctcaccatcagcagcctgcagcctagaagatttcngacctaaccttattacttgtacaaactaatttaaggactttaccctctccttccgttcgggacggtagggaccgaagggtgagtaatacaaacgactggtacggctacgacactac

SEQ ID NO: 19817 - DNA, 574 bp, Homo sapiens
  misc_feature: GYAE6OF02IVWM0.25.86.H09.1.454.CMB.1.raw
  modified_base (246)..(246): a, c, t, g, unknown or other
  misc_feature (246)..(246): n is a, c, g, or t
  modified_base (516)..(517): a, c, t, g, unknown or other
  misc_feature (516)..(517): n is a, c, g, or t
  modified_base (519)..(520): a, c, t, g, unknown or other
  misc_feature (519)..(520): n is a, c, g, or t
  modified_base (522)..(529): a, c, t, g, unknown or other
  misc_feature (522)..(529): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
tcagactgtacagtcacgaccggtgctcgatttagtgctatagactttgggttttggggaggaagaacctactatgtcgacgactcgtacgtgaaggggtacgacttcacccacctccagtagactaaccactcaagaacctccctggtatcctgcaaactcgggacaagttctgtacacctgatgaccaccgccttgtattattgtgtgaaggcgtggttgaggtgaactcgcctggaaccccgnggtcaggccactacttctacattggggactctggggtcaaagggacttacggtcaatcgtactcctcgacgccgtcccaccaacgggtcccaatccggtcttccccctggccgccctcgctccagggacgcaccgtcccgagaccgcaccaggtccggcccgttggggccgttggtcccgtgggtaccaaagggaccttacttcccacttcgtaacccaagttcctaggacgccggggccttcgggacctaagggccgtacttagacgtnntnntnnnnnnnntgcncnctctcgcgngcgagngngnnanangngcncgncntnntc

SEQ ID NO: 19818 - DNA, 196 bp, Homo sapiens
  misc_feature: GYAE6OF02F7QDH.25.86.H09.1.454.CMB.1.raw
  modified_base (194)..(196): a, c, t, g, unknown or other
  misc_feature (194)..(196): n is a, c, g, or t
tcagactgtacagtcacgaccggtgctcgatttagtgctatagacttgggtttgggatgccagtctgagtggtccgacggtgttcggcggagggaccaagctgaccgtcctaggtcagcccaaggctgccccctcggtcactctgttcccgcctcctcactgtacagtctgagcgggctggcaaggcgcatagnnn

SEQ ID NO: 19819 - DNA, 502 bp, Homo sapiens
  misc_feature: GYAE6OF02F0SKX.25.86.H09.1.454.CMB.1.raw
  modified_base (432)..(432): a, c, t, g, unknown or other
  misc_feature (432)..(432): n is a, c, g, or t
tcagactgtacagtcacgaccggtgctcgatttagtgctatagacttgggtttgggggacacctgggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcagacccactcaggacacagcatggacatgaggtccccgctcagctcctggggcttctgctgctctggctcccaggtgccaaatgtgccatccagttgacccagtcctccatcctccctgtctcgcctctgttcgagacatagtcaccatcacttgtcggctagtcgggtcagttggcagtgtctttagcctggtatcagcaagaaaccgaggggaacnctacctaagcttcctgactctttgattcgccttccgtagttacggaagtcggacgtcccagtcgtaacgg

SEQ ID NO: 19820 - DNA, 579 bp, Homo sapiens
  misc_feature: GYAE6OF02IRNAG.25.86.H09.1.454.CMB.1.raw
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatcttgatgcctcagtttggaaagtggagtcccatcaaggttcagcggcagtggatctgggacagatttcatcctcaccatcagcagcctgcagcctgaagatttcngacctaaaccttatttattgtactaaactaagttttaaacggactttacccctcttccttcccgtttacggggaccgggtaaggggtaccctaaagggggttcgggaacggtaacttaaccgaaaaaccggtaaccttgggttacgggccttacgggaccctaacccgtagttcccgttacgg

SEQ ID NO: 19821 - DNA, 497 bp, Homo sapiens
  misc_feature: GYAE6OF02H1U34.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtcccatcaaggttcagcggcaggtggatctgggacagattttcatcctcaccatcagcagcctgcagcctgaagattctgcaaccttattattgtcaaactaatttaaggatttaccctctctccgttcggcggaggaccgaaggtggagatacgaaagactggtgctgcactac

SEQ ID NO: 19822 - DNA, 196 bp, Homo sapiens
  misc_feature: GYAE6OF02IW6Y6.25.86.H09.1.454.CMB.1.raw
  modified_base (195)..(196): a, c, t, g, unknown or other
  misc_feature (195)..(196): n is a, c, g, or t
tcagactgtacagtcacgaccggtgctcgatttagtgctatagacttgggtttgggatgccagtctgagtggtccgacggtgttcggcggagggaccaagctgaccgtcctaggtcagcccaaggctgccccctcggtcactctgttcccaccctcctcactgtacagtctgagcgggctggcaaggcgcatagnn

SEQ ID NO: 19823 - DNA, 414 bp, Homo sapiens
  misc_feature: GYAE6OF02HSYN9.25.86.H09.1.454.CMB.1.raw
  modified_base (383)..(383): a, c, t, g, unknown or other
  misc_feature (383)..(383): n is a, c, g, or t
  modified_base (411)..(414): a, c, t, g, unknown or other
  misc_feature (411)..(414): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggctacggtcatcgtctcctcagcctccaccaagggcccatcggtcttccccctggcgccctgctccaggagcacctccgagagcacagcggccctgggctgcctggtcaagctacttccactgtacngtctgagcgggctggcaaggcgcatagnnnn

SEQ ID NO: 19824 - DNA, 417 bp, Homo sapiens
  misc_feature: GYAE6OF02I6RPJ.25.86.H09.1.454.CMB.1.raw
  modified_base (411)..(417): a, c, t, g, unknown or other
  misc_feature (411)..(417): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaagggactacggtcatcgtctcctcagcctccaccaagggcccatcggtcttccccctggcgccctgctccaggagcacctccgagagcacagcggcctgggctgcctggtcaaggctactccactgtacagtctgagcgggctggcaaggcgcatagnnnnnnn

SEQ ID NO: 19825 - DNA, 418 bp, Homo sapiens
  misc_feature: GYAE6OF02FY5TU.25.86.H09.1.454.CMB.1.raw
  modified_base (414)..(418): a, c, t, g, unknown or other
  misc_feature (414)..(418): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggcccatcggtcttccccctggcgccctgctccaggagcacctccgagagcacagcggccctgggctgcctggtcaaggctacttccactgtacagtctgagcgggctggcaaggcgcatagnnnnn

SEQ ID NO: 19826 - DNA, 565 bp, Homo sapiens
  misc_feature: GYAE6OF02IR3U3.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagtttggaaagtggagtccatcaaggttcagcggcagtggatcgtggacagtatttcatcctcaccatcagcagcctgcagcctagaagacttctgactaaccttattattagtactaaactaattttaacggactttaacccctcttaccgttccgttacggggaccgggtaacgggtaacccggtaagggttacgggaacgtaacgtaaccgtaaaacgtaacgttcggtacggtaccgtacggaccctaccgtacg

SEQ ID NO: 19827 - DNA, 497 bp, Homo sapiens
  misc_feature: GYAE6OF02IL6A3.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatctgggacagatttcatcctcaccatcagcagcctgcagcctgaagattctgccaacctattattgtacaactaatttaaggacttaccctctctccttcggcgagggaccaagggtggagatacaaagtactgtggctgcacctac

SEQ ID NO: 19828 - DNA, 419 bp, Homo sapiens
  misc_feature: GYAE6OF02I5ATJ.25.86.H09.1.454.CMB.1.raw
  modified_base (386)..(386): a, c, t, g, unknown or other
  misc_feature (386)..(386): n is a, c, g, or t
  modified_base (413)..(419): a, c, t, g, unknown or other
  misc_feature (413)..(419): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagccctccaccaagggcccatcggtcttccccctggccgccctgctccaggagcacctccgagagcacagcggccctgggctgcctggtcaaggctactccactgtacngtctgagcgggctggcaggcgcatagnnnnnnn

SEQ ID NO: 19829 - DNA, 422 bp, Homo sapiens
  misc_feature: GYAE6OF02HYU43.25.86.H09.1.454.CMB.1.raw
  modified_base (414)..(422): a, c, t, g, unknown or other
  misc_feature (414)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatcggtcttccccctggcgccctgctccaggagcacctccgagagcacagcggccctgggctgcctggtcaaggactactccactgtacagtctgagcgggctggcaaggcgcatagnnnnnnnnn

SEQ ID NO: 19830 - DNA, 731 bp, Homo sapiens
  misc_feature: GYAE6OF02GTRXI.25.86.H09.1.454.CMB.1.raw
tcagactgtacagtcacgaccggtgctcgatttagtgctatagactgggggtttgggggagtcgaggacccactcaggactacgagcactcggacagtcgaggggtccccgctcagcttccctcgggcctttcctgctgcgtctggcgtcccagggtcgccaatgtcgccatccagttcacccacgtcctccatccgtccctcgtcgtgccttctgttccgacgactatacgtcaccatcgaaccttcgtcggctaggttcgggtctagttggactagtcgcttttacgccgttggtactacaagtccaaggaaacccaagggggaaccactcctaagcctaccttgatctttgactgacctccgacgtttggaaaggttcggaacgtcccgattcaacggttcgacgtccggactagttcgggactcgtaggggacctacgtagtttaccacttccctcgtaccgacttcccgaaggtcctacggaccgtaggaccgacggtccctaggtaaacgttactttccgtacgacctaaaccgttactttaacgttacgtacctaaacggtaaacgttttaaacgggaacctttaacccgtccttaccgttcccgtttacggggtccgggaacggggtacccggtaagggtacgggaacgtaacgtacccggtaaaacggtaaccgttcggtacggtcccgtacggcccgtaacccgtccgttaccgttaccgg

SEQ ID NO: 19831 - DNA, 598 bp, Homo sapiens
  misc_feature: GYAE6OF02HTMIB.25.86.H09.1.454.CMB.1.raw
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
  modified_base (545)..(546): a, c, t, g, unknown or other
  misc_feature (545)..(546): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagactgtacagtcacgaccggtgctcgatttagtgctatagacttgggtttgggaggaagaacctacttatgcagactctgtagaagggtccgattcaccacctaccaagagacaacatcaaggaactccctgtatctgcaaatggacagtctggacacctgatgacaccgccttgtattattgtgtggaaaggcggtgttggaggtgaatgacctcggaaccccgcggtcagcactacttctacatgggcgtctggggcaaagggctacggtcatcgtcttcctcgaggcctccgaaccaacgggccccagtcccgggtccgttcccccgtgggccgcccgttggccgttaccgagggtacgtccaaccgttccgggagacgccaacctaacggcccgggccccttggggccttacggcccttagggtaccaaacgggtaccttaccgttacccgaacgttacggtaccaggtacctacggaacggtccgggactcggggacaaagggcgacgatacggnacgcgacgncnacgctagntcnngngcgngcgcncncgcgngtcgngngngngcgagtgtgcgacgacganancg

SEQ ID NO: 19832 - DNA, 573 bp, Homo sapiens
  misc_feature: GYAE6OF02JAB35.25.86.H09.1.454.CMB.1.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacctagtctccatcctcctgtctgcctctgttcgagacatagtcaccatcacgttgtcgggctagtcgggtcattggcagtgctttagcctggtatcagcagaaccnggggaanctcctaagctcctgatcttgatgcctcagttgaagtgagtccatcaagttcagcggcagtgatcgtgggacagatttcatcctcacatcagcagcctgacagcctagaacgtatttccgtgacctaaaccgttatttaacgttcgtacaaaccgtaaattttaacgggacctttaaccctccttccttaccgtttacgggacgggtaacggtacccgaaggggttcggaaggtaacgtacgtaaaaccggtacgttaggtacggtaccgttcgaccgtaacccgtagttaccgttccgg

SEQ ID NO: 19833 - DNA, 414 bp, Homo sapiens
  misc_feature: GYAE6OF02IDSLJ.25.86.H09.1.454.CMB.1.raw
  modified_base (217)..(217): a, c, t, g, unknown or other
  misc_feature (217)..(217): n is a, c, g, or t
  modified_base (412)..(414): a, c, t, g, unknown or other
  misc_feature (412)..(414): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaggggactacggtcatcgtctcctcagcctccaccaagggcccatcggtcttccccctggcgccctgctccaggagcacctccgagagcacagcggcctgggctgcctggtcaggactacttccactgtacagtctgagcgggctggcaaggcgcatagnnn

SEQ ID NO: 19834 - DNA, 499 bp, Homo sapiens
  misc_feature: GYAE6OF02GFRCY.25.86.H09.1.454.CMB.1.raw
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtcccatcaaggttcagcggcagtggatctgggacagatttcatcctcaccatcagcagcctgcagcctgaagtnttctgcaaccttattattgtacaactaatttaacggattaccctctcctccttcggcggacggacctaagggtggagatacaaacgactgtagctgcacta

SEQ ID NO: 19835 - DNA, 520 bp, Homo sapiens
  misc_feature: GYAE6OF02GEK5W.25.86.H09.1.454.CMB.1.raw
  modified_base (279)..(279): a, c, t, g, unknown or other
  misc_feature (279)..(279): n is a, c, g, or t
  modified_base (368)..(368): a, c, t, g, unknown or other
  misc_feature (368)..(368): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaagtgagtccatcaaggttcagcggcagtggatcgtgggacagatttcatcctnaccatcagcagcctgcagcctagaagtacttctgacaaccttattattgtactaaactaatttaacgactttaccctcttccttccgttcgggacggacgggtaccgaagggttagagtataccgaaacgtactggtacggctgcacctacg

SEQ ID NO: 19836 - DNA, 651 bp, Homo sapiens
  misc_feature: GYAE6OF02I67UT.25.86.H09.1.454.CMB.1.raw
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
tcagactgtacagtcacgaccggtgctcgatttagtgctatagacttggggttttggggagaagtaacctactattcgcagactcttgtggaagggtttccgagttacacccaaccgtcccagtagtacaacctatcaagaacctccctgtactctgcaaatggaccagtctgtacaccttcggattgaccaccggacccttgtacttacttgttacggtgaaaacggcggtcggttcgaaggtgaatcgtcctcggaaccccccgtcggtccagaccacctaacttctacatggtactctcgggcaaacgggactacggtctagtccgtctcctcgacgccctccacccaagggcccccattaccggttccgttccccctgggacccgtcccgtcgtccgtccgagggacgccttacccgtcccgagtacgcctaccagtccggccctgggcctgcccgtggtctaacggtactacttcccactgtaccagtctcgacgcgggctcggaccaaacgggtccgacaagtacgtacagacnctaccaccanaccganacgtacgcgtcgctcgtccgcgacgtcgtcgtcgcgtacgtacgttcgttcccgttcctacctccgtcccgtcctctctcgtactacgtacgtcg

SEQ ID NO: 19837 - DNA, 504 bp, Homo sapiens
  misc_feature: GYAE6OF02GJRR6.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagatttcatcctcaccatcagcagcctgcagccttgaagattctgcaacctatttattgtactaaactaatttaaggactttaccctcttccttccttcgggcgagggaccaagggtgagatcaaacgactggtggctgcactac

SEQ ID NO: 19838 - DNA, 520 bp, Homo sapiens
  misc_feature: GYAE6OF02F900L.25.86.H09.1.454.CMB.1.raw
  modified_base (403)..(403): a, c, t, g, unknown or other
  misc_feature (403)..(403): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagatttcatcctcaccatcagcagcctgcagcctgaagtattcngactaaccttattacttgtacaaactaatttaacggactttaccctcttcttccttcgggcggtacgggaccgaagggtggaggactacgaaacgtacgtgtaggctggccacctac

SEQ ID NO: 19839 - DNA, 419 bp, Homo sapiens
  misc_feature: GYAE6OF02GZ990.25.86.H09.1.454.CMB.1.raw
  modified_base (413)..(419): a, c, t, g, unknown or other
  misc_feature (413)..(419): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggctacggtcatcgtctcctcagcctccaccaagggcccatcggtcttccccctggccgccctgctccaggagcacctccgagagcacagcggccctgggctgcctggtcaaggctacttccactgtacagtctgagcgggctggcaaggcgcatagnnnnnnn

SEQ ID NO: 19840 - DNA, 420 bp, Homo sapiens
  misc_feature: GYAE6OF02ILMNW.25.86.H09.1.454.CMB.1.raw
  modified_base (217)..(217): a, c, t, g, unknown or other
  misc_feature (217)..(217): n is a, c, g, or t
  modified_base (415)..(420): a, c, t, g, unknown or other
  misc_feature (415)..(420): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggactacggtcatcgtctcctcagcctccaccaagggccccatcggtcttccccctggccgccctgctccaggagcacctccgagagcacagcggccctgggctgcctggtcaaggactacttccactgtacagtctgagcgggctggcaaggcgcatagnnnnnn

SEQ ID NO: 19841 - DNA, 516 bp, Homo sapiens
  misc_feature: GYAE6OF02I1BF3.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatctgggacagatttcatcctcaccatcagcagcctgcagcctgaagattctgacaacctattattgtactaactaatttaaggactttaccctctccttccgttcggacggtacgggaccgaagggttcggaagtatacgaaacgtactggtacggctcgcactac

SEQ ID NO: 19842 - DNA, 415 bp, Homo sapiens
  misc_feature: GYAE6OF02FIA47.25.86.H09.1.454.CMB.1.raw
  modified_base (413)..(415): a, c, t, g, unknown or other
  misc_feature (413)..(415): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggcccatcggtcttcccctgcgccctgctccaggagcacctccgagagcacagcggccctgggctgcctggtcaaggactacttccactgtacagtctgagcgggctggcaaggcgcatagnnn

SEQ ID NO: 19843 - DNA, 553 bp, Homo sapiens
  misc_feature: GYAE6OF02GSIYL.25.86.H09.1.454.CMB.1.raw
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttgaaagtgagtccatcaaggttcagcggcagtggatcgtgggacaggatttcatcctcaccatcagcagcctgcagcctgaagattcngccaaaccttattacgttntacctaaactaagttttaaacggactttaacccctacttccttacccgttcgggccgggtaagggacccgtaagggttaggaacggtaacttaccgaaacggtaacttcggtacggaccttcggaccaccgtacg

SEQ ID NO: 19844 - DNA, 526 bp, Homo sapiens
  misc_feature: GYAE6OF02I43JD.25.86.H09.1.454.CMB.1.raw
  modified_base (404)..(404): a, c, t, g, unknown or other
  misc_feature (404)..(404): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatctggggacagattttcatccctcaccatcagcagcctgcagcctgaagattcngcaacctattattgtacaactaatttaaggactttaccctcttccttccgttcggaccggtagggaccctaagggtggaagtataccgaaacgtaacgtggtacggactggaccacctaacg

SEQ ID NO: 19845 - DNA, 505 bp, Homo sapiens
  misc_feature: GYAE6OF02I5REP.25.86.H09.1.454.CMB.1.raw
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcgcagtggatctgggacagatttcattcctcaccatcagcagcctgcagccngaagnttcngcaactattatganaacaatttaagcttaccctntactccgttcggacgtaggaccaaggtgganaacttacgaaaacgacgttggtcggacttcggacaccctag

SEQ ID NO: 19846 - DNA, 422 bp, Homo sapiens
  misc_feature: GYAE6OF02HYV7N.25.86.H09.1.454.CMB.1.raw
  modified_base (412)..(412): a, c, t, g, unknown or other
  misc_feature (412)..(412): n is a, c, g, or t
  modified_base (417)..(422): a, c, t, g, unknown or other
  misc_feature (417)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggctacggtcatcgtctcctcagcctccaccaagggccccatcggtcttccccctggccgccctgctccaggacgccacctccgagagcacagcggccctgggctgcctggtcaaggactacttccactgtacagtctgagcgggctggcaaggcgnatagnnnnnn

SEQ ID NO: 19847 - DNA, 495 bp, Homo sapiens
  misc_feature: GYAE6OF02GHVHC.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtcccatcaaggttcagcggcagtgatctgggacagatttcatcctcaccatcagcagcctgcagcctgaagtattctgcaaccttattattgtacaactaatttaaggacttaccctctctccttcggcgaggaccaaggtggagatacaacgactggtggctgacactac

SEQ ID NO: 19848 - DNA, 509 bp, Homo sapiens
  misc_feature: GYAE6OF02GDBG6.25.86.H09.1.454.CMB.1.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagatttcatcctcaccatcagcagcctgcagcctagaagtattctgaccaaccttattattgtacaaactaatttaaggtactttacccttctccttccgttcggcggacggaccaaggtggagatacaaacgactgtggctgcactatctcg

SEQ ID NO: 19849 - DNA, 530 bp, Homo sapiens
  misc_feature: GYAE6OF02GH6UQ.25.86.H09.1.454.CMB.1.raw
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtcccatcaaggttcagcggcaggtggatcgtgggacagatttcatcctcaccatcagcagcctgcagcctagaagtnttcngaccaaccttattattgtacaactaattttaaggactttaccctcttcctccgttcgggacggtacgggacctaagggtcggaagtaactaccgaaacgtaactggtacggctagaccacccgtatctcg

SEQ ID NO: 19850 - DNA, 519 bp, Homo sapiens
  misc_feature: GYAE6OF02IIQ18.25.86.H09.1.454.CMB.1.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccnggggaanctcctaagctcctgatctttgatgcctcagtttggaaagtggagtcccatcaaggttcagcggnagtggatctgggacagtatttcatcctcaccatcagcagcctgcagcctgaagtnttcngacctaaccttattattgtacaaactaattttaaggaactttaccctctaccgtccgttcgggcggtagggaccaagggtggacgtataccaaagtacctggtacggctcgcacctag

SEQ ID NO: 19851 - DNA, 561 bp, Homo sapiens
  misc_feature: GYAE6OF02ILRJB.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagctcctaagctcctgatctttgatgcctcagtttggaaagtggagtccatcaaggttcagcggcagtggatcgtggacagtatttcgattcctcaccatcagcacgcctgccagccttgaagtattctcgacaaccttattattagtacaaataagtttaacgactttaccccgtacttcccgttccgttcgggacgggtaacgggtaccgaaagggttcggaacgtaactaaccgaaaacggtacgttacggtacggtaccgtacgtaccaccgttaacg

SEQ ID NO: 19852 - DNA, 416 bp, Homo sapiens
  misc_feature: GYAE6OF02ITCJP.25.86.H09.1.454.CMB.1.raw
  modified_base (218)..(218): a, c, t, g, unknown or other
  misc_feature (218)..(218): n is a, c, g, or t
  modified_base (414)..(416): a, c, t, g, unknown or other
  misc_feature (414)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggactacggtcatcgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnnn

SEQ ID NO: 19853 - DNA, 423 bp, Homo sapiens
  misc_feature: GYAE6OF02IOR6Z.25.86.H09.1.454.CMB.1.raw
  modified_base (218)..(218): a, c, t, g, unknown or other
  misc_feature (218)..(218): n is a, c, g, or t
  modified_base (417)..(423): a, c, t, g, unknown or other
  misc_feature (417)..(423): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaggggactacggtcatcgtctcctcagtctccaccaagggcccatcggtcttccccctggccgccctgctccaggagcacctccgagagcacagcggccctgggcctgcctggtcaaggactacttccactgtacagtctgagcgggctggcaaggcgcatagnnnnnnn

SEQ ID NO: 19854 - DNA, 534 bp, Homo sapiens
  misc_feature: GYAE6OF02J2IE0.25.86.H09.1.454.CMB.1.raw
  modified_base (367)..(367): a, c, t, g, unknown or other
  misc_feature (367)..(367): n is a, c, g, or t
  modified_base (456)..(456): a, c, t, g, unknown or other
  misc_feature (456)..(456): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcgcagtgatctgggacagatttcatcctnaccatcagcagcctgcagcctagaacgtattcctagcctaaccttaatttatcgttacaaactaaattttaacggactttaaccccttntcctccgttcgggcgagggacctaaagggttcggaagtaactaccgaaaagaccttggacggtctcggacctacccta

SEQ ID NO: 19855 - DNA, 425 bp, Homo sapiens
  misc_feature: GYAE6OF02HW9HG.25.86.H09.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
  modified_base (418)..(425): a, c, t, g, unknown or other
  misc_feature (418)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggactacggtcatcgtctcctcagcctccaccaagggccccatcggtcttccccctggcnccctgctccaggagcacctccgagngcacagccggccctgggctgcctggtcaaggactacttccactgtacagtctgagcgggctggcaaggcgcatagnnnnnnnn

SEQ ID NO: 19856 - DNA, 437 bp, Homo sapiens
  misc_feature: GYAE6OF02ILV9N.25.86.H09.1.454.CMB.1.raw
  modified_base (219)..(219): a, c, t, g, unknown or other
  misc_feature (219)..(219): n is a, c, g, or t
  modified_base (417)..(418): a, c, t, g, unknown or other
  misc_feature (417)..(418): n is a, c, g, or t
  modified_base (420)..(437): a, c, t, g, unknown or other
  misc_feature (420)..(437): n is a, c, g, or t
tcagactgtacagtcacgaccggtgctcgatttagtgctatagacttggggttgggagaagaacctactatgcagactctgtgaagggtccgattcaccacctccagagacaacatcaagaactccctgtatctgcaagtggacagtctgacacctgatgacaccgccttgtattattgtgtgaaaggcggtgttgaggtgaatgcctggaacccccgnggtcagcactacttctacatgggcgtctggggcaaaagggactacggtcatcgtctcctcagcctcaccaaggcccatcggtcttcccctggccgccctggcctccgaggacgccacctccgagacgcacagcggcctgggctgcctggcaaggactactccactgtacagtctgagcgggctggcaaggcgcatagnngnnnnnnnnnnnnnnnnnn

SEQ ID NO: 19857 - DNA, 501 bp, Homo sapiens
  misc_feature: GYAE6OF02HE2LL.25.86.H09.1.454.CMB.1.raw
tcagactgtacagtcacgaccggtgctcgatttagtgctatagacttgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgctaatttggggtccctctcgattcagcggcagtgggtctgggacagaattcactctcaccatcagcagcctgcagcctgaagatgttgactaacttattactagttactaaaatttgaactagtgaccgtggtacgtgttccggacccgagggaccgaaggtcggacgatacgaacgtactgtacgg

SEQ ID NO: 19858 - DNA, 507 bp, Homo sapiens
  misc_feature: GYAE6OF02FE7AL.25.86.H09.1.454.CMB.1.raw
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
  modified_base (460)..(460): a, c, t, g, unknown or other
  misc_feature (460)..(460): n is a, c, g, or t
  modified_base (467)..(474): a, c, t, g, unknown or other
  misc_feature (467)..(474): n is a, c, g, or t
  modified_base (477)..(494): a, c, t, g, unknown or other
  misc_feature (477)..(494): n is a, c, g, or t
  modified_base (496)..(497): a, c, t, g, unknown or other
  misc_feature (496)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
tcagactgtacagtcacgaccggtgctcgatttagtgctatagacttggggtttgggagaagaacctactatgcagactctgttgaagggtcgattcaccactccagagacaacatcaagaactccctgtatcttgcaaatggacagtctgacacctgatgacaccgcttgtattattgtgtgaaaggcggtgttgaggtgaatgcctggaaccccgcggtcagcactactctacatgggcgtctggggcaaagggctacggtcatcgtcnccttcagcctccaccaacgggcccagtcggtccttccccgnggccgccctgctccgaggacgcgaccgtccgagacgcacgacgccggcccgtgggccttcggccgtaggtacaaagggtaccttaccttcccgacgttcgtacgacggtctaggacggcgggctcggacgaaacgggccacaagtagnactcgannnnnnnncgnnnnnnnnnnnnnnnnnngnngngncncnnc

SEQ ID NO: 19859 - DNA, 532 bp, Homo sapiens
  misc_feature: GYAE6OF02HDG17.25.86.H09.1.454.CMB.1.raw
  modified_base (364)..(364): a, c, t, g, unknown or other
  misc_feature (364)..(364): n is a, c, g, or t
tcagactgtacagtcacgaccggtgctcgatttagtgctatagacttgggtttggggggacacctggggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcagacccactcaggacacagcatggacatgagggtccccgctcagctcctggggcttctgctgctctggctcccaggtgccaaatgtgccatccagttcgacccagtctccatcctccctgtctgcctctgttcgagacatacgtcacntcacttgtcggctaggtcgggtcagttggctagtgctttagccttggtactcagcagaaaccgaggggaacgctaccgtaagcctacctgtacttcgtttggacttcggcccttccgtaggttttacgggaaagttcgggaacgtttaccccgtattaccgtaacggg

SEQ ID NO: 19860 - DNA, 452 bp, Homo sapiens
  misc_feature: GYAE6OF02HBSYJ.25.86.H09.1.454.CMB.1.raw
  modified_base (218)..(218): a, c, t, g, unknown or other
  misc_feature (218)..(218): n is a, c, g, or t
  modified_base (428)..(428): a, c, t, g, unknown or other
  misc_feature (428)..(428): n is a, c, g, or t
  modified_base (433)..(452): a, c, t, g, unknown or other
  misc_feature (433)..(452): n is a, c, g, or t
tcagactgtacagtcacgaccggtgctcgatttagtgctatagacttggggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagccactacttctacatgggcgtctggggcaaagggactacggtcaatcgtctcctcagcctccaccaagggcccatcgggtccttccccctgggccgccctcggcctccgaggacgccacctccgagacgcacaggccggccctgggcctgccctggtacaaggacctacttccactgtacagtctggagcgggctggcaaggcncatgnnnnnnnnnnnnnnnnnnnn

SEQ ID NO: 19861 - DNA, 552 bp, Homo sapiens
  misc_feature: GYAE6OF02JJMQ5.25.86.H09.1.454.CMB.1.raw
  modified_base (396)..(396): a, c, t, g, unknown or other
  misc_feature (396)..(396): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctccctgtctgcctctgttcgagacatagtcaccatctacttggtcgggctaggtcgggtctagttggcagtgtctttacgtccgtggttactcaggaccagggaaaaacccagggggaagactccctaaagctcctgatctttgatgcctccagtttggaaagtggagtcccatcaaggttcagcggcagtggatctggggacagatttcatcctnaccatcagcagcctgcagcctgaagattctagctaacctattattagtactaaactaatttaacggacttaaccctctactccgttcggacggtagggtacccaaagggttggaagaacgtacaaacggaacgttgtacgggctacggaccaccta

SEQ ID NO: 19862 - DNA, 491 bp, Homo sapiens
  misc_feature: GYAE6OF02GPOU5.25.86.H09.1.454.CMB.1.raw
  modified_base (279)..(279): a, c, t, g, unknown or other
  misc_feature (279)..(279): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggatcccatcaaggttcagcggcagtggatctgggacagtatttcatcctcaccatcagcagcctgcagcctganattcngcaacctattatgtacaactaatttaagattaccctctctccttcggcggacggaccaagggtgagatacaaacgactgtggctgcactac

SEQ ID NO: 19863 - DNA, 553 bp, Homo sapiens
  misc_feature: GYAE6OF02F5FH6.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatcgcctccagtttggaaagtggagtcccatcaaggttcagcggcagtgatcgtgggacagatttcatcctcaccatcagcagcctgcacgcctagaagattctgacctaaaccttatttattgtacaacgttaaatttaacggactttaaccctcttccttacccgttcgggtacgggaacgggtacccgaaagggttcggaagtactaacgaaaccggacgttacggtacggtactcggtaccaccctacg

SEQ ID NO: 19864 - DNA, 416 bp, Homo sapiens
  misc_feature: GYAE6OF02G7DGR.25.86.H09.1.454.CMB.1.raw
  modified_base (405)..(405): a, c, t, g, unknown or other
  misc_feature (405)..(405): n is a, c, g, or t
  modified_base (410)..(416): a, c, t, g, unknown or other
  misc_feature (410)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgcggtcagcactacttctacatgggcgtctggggcaaagggctacggtcatcgtctcctcagcctccaccaaggcccatcggtcttccccctggccgccctgctccaggagccacctccgagagcacagcggccctgggctgctggtcaaggctacttccactgtacagtctgagcggctggcaaggcgnatagnnnnnnn

SEQ ID NO: 19865 - DNA, 434 bp, Homo sapiens
  misc_feature: GYAE6OF02JJ8Y2.25.86.H09.1.454.CMB.1.raw
  modified_base (417)..(417): a, c, t, g, unknown or other
  misc_feature (417)..(417): n is a, c, g, or t
  modified_base (423)..(434): a, c, t, g, unknown or other
  misc_feature (423)..(434): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggccccatccggtcttccccctggccgccctgcctccaggacgcacctccgagagcacagccggccctgggcctgccctggtcaaggacctactcccactgtacagtctgagcgggctggcaaggcncatagnnnnnnnnnnnn

SEQ ID NO: 19866 - DNA, 571 bp, Homo sapiens
  misc_feature: GYAE6OF02FQ8FE.25.86.H09.1.454.CMB.1.raw
  modified_base (398)..(398): a, c, t, g, unknown or other
  misc_feature (398)..(398): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagttccatcaaggttcagcggcagtggatcgtgggacagtatttcatcctcaccatcagcagcctgcagcctagaagtnttctgaccaaccttatttacttgtactaaacgtaattttaaggactttaccccttcttccttcccgtttacgggaccgggtaacgggaccgtaagggtacgggaacgtaacgtaacgtaaaaccggtaacgttacggtacggtaccgttacgaccgtacctagtccgttacgg

SEQ ID NO: 19867 - DNA, 533 bp, Homo sapiens
  misc_feature: GYAE6OF02ILBST.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagtatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtcccatcaaggttcagcggcagtggatcgtgggacagtatttcatcctcaccatcagcagcctgcagcctgaagtattctgacctaaacctatttattgtactaaactaattttaaggactttaccctcttctcccgttcgggacggtagggacctaagggtcggaagactacgaaacggtacgttggtacggcctgaccacctattccg

SEQ ID NO: 19868 - DNA, 427 bp, Homo sapiens
  misc_feature: GYAE6OF02JE7E8.25.86.H09.1.454.CMB.1.raw
  modified_base (218)..(218): a, c, t, g, unknown or other
  misc_feature (218)..(218): n is a, c, g, or t
  modified_base (415)..(415): a, c, t, g, unknown or other
  misc_feature (415)..(415): n is a, c, g, or t
  modified_base (421)..(427): a, c, t, g, unknown or other
  misc_feature (421)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaaggggactacggtcatcgtctcctcagcctccaccaagggcccatcggtcttccccctggccgccctgctccaggacgccacctccgagagcacagccggccctgggcctgcctggtcaaggctacttccactgtacagtctgagcgggctggcaagggcncatagnnnnnnn

SEQ ID NO: 19869 - DNA, 571 bp, Homo sapiens
  misc_feature: GYAE6OF02HUKZM.25.86.H09.1.454.CMB.1.raw
  modified_base (279)..(279): a, c, t, g, unknown or other
  misc_feature (279)..(279): n is a, c, g, or t
  modified_base (401)..(401): a, c, t, g, unknown or other
  misc_feature (401)..(401): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtcccatcaagttcagcggcagtggatctgggacagtatttcatcctcaccatcagcagcctgcagcctgaagattcngacctaaccttattattgtacctaaactaattttaaaggacttttaaccccgtcttaccttccgttccgggaccgggtaacggggtaacccgtaaaggggttcgggaagaacgttaaccgaaaacggtaaccttagggtcgggtaccgtacggtacccgaacccttaacg

SEQ ID NO: 19870 - DNA, 417 bp, Homo sapiens
  misc_feature: GYAE6OF02HOVC6.25.86.H09.1.454.CMB.1.raw
  modified_base (413)..(417): a, c, t, g, unknown or other
  misc_feature (413)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtcttccccctggcgccctgctccaggagcacctccgagagcacagcggccctgggctgcctggtcaaggctacttccactgtacagtctgagcgggctggcaaggcgcatagnnnnn

SEQ ID NO: 19871 - DNA, 518 bp, Homo sapiens
  misc_feature: GYAE6OF02GZ7HF.25.86.H09.1.454.CMB.1.raw
  modified_base (275)..(275): a, c, t, g, unknown or other
  misc_feature (275)..(275): n is a, c, g, or t
  modified_base (395)..(395): a, c, t, g, unknown or other
  misc_feature (395)..(395): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaagtggagtcccatcaaggttcagcggcagtggatcgtgggacagtatttcatcctcaccatcagcagcctgcagcctagaagtnttctgacctaaccttattattcgtacaaactaatttaacggactttaccctctcctccgttcggacggtaggacctaagggtggaagtactacgaaacgtacgtgtacgctgacactatctcg

SEQ ID NO: 19872 - DNA, 521 bp, Homo sapiens
  misc_feature: GYAE6OF02IX347.25.86.H09.1.454.CMB.1.raw
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaagtgagtccatcaaggttcagcggcagtgatctgggacagtatttcactcctcaccatcagcngcctgcagcctgaacgtnttctcgacctaaccttattattgtactaactaatttaaggtactttaccctcttcctccgttcggacggtaggaccgaagggtacggagaacgtacgaaacgtacgtgtcgtctcggacacctacg

SEQ ID NO: 19873 - DNA, 425 bp, Homo sapiens
  misc_feature: GYAE6OF02G4L8W.25.86.H09.1.454.CMB.1.raw
  modified_base (218)..(218): a, c, t, g, unknown or other
  misc_feature (218)..(218): n is a, c, g, or t
  modified_base (328)..(328): a, c, t, g, unknown or other
  misc_feature (328)..(328): n is a, c, g, or t
  modified_base (388)..(388): a, c, t, g, unknown or other
  misc_feature (388)..(388): n is a, c, g, or t
  modified_base (416)..(425): a, c, t, g, unknown or other
  misc_feature (416)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggctctggggcaaagggactacggtcatcgtctcctcagcctccaccaagggccccatcggtcttccccctggcgccctgctccaggancacctccgagagcacagccggccctgggctgccctggtcaaggactacttccactgtacngtctgagcgggctggcaaggcgcatagnnnnnnnnnn

SEQ ID NO: 19874 - DNA, 799 bp, Homo sapiens
  misc_feature: GYAE6OF02F4R58.25.86.H09.1.454.CMB.1.raw
  modified_base (307)..(307): a, c, t, g, unknown or other
  misc_feature (307)..(307): n is a, c, g, or t
tcagactgtacagtcacgaccggtgctcgatttagtgctatagacttaggggtttaggggggcaggagtccagacccactcaggacacagtcatggacatgagggtccccgctcagctcctggggcttctgctgcttcgtggctcccaggtggtccaaattgtgcctaatccgagttcgacccagtctccgatcctcctgtctgcctctggttcgagacatagtccaccgatccacttggtccgggcttacggtcgggtcattcggctagtgcttttagccttggtatcagcagaaaccgagggaancctaccgtaaggcctccgtaggacttccgtttaggacgtcggcccttccggtaagggttttacgggaaaaggttcggtaacggtttacccctaagttacccgaaaaggggttttccgaacggtaccgggtacgtaaagggttacgggaactttacggttacggggtaactaggttaactttttacgaaccgtttccccgttaccgaaacccgtactaccgtaacgtaccgtaacgttcccgtaggaccgaacggtacccgttaagaaacgtaactttaccgtacgtaacccttaaacctttaagtttacgtttaacgtaacctaaaaacgttaaagttttaaacggtaacctttaaccccgttacgttacccgttacccggttaccgggacgggtaaccgggtaccgtaaaggggttacggtaaacggtaacttaaccgtaaaaccgtacgttacggttaacggtacgtacggtacccgtaaccgttaacgg

SEQ ID NO: 19875 - DNA, 416 bp, Homo sapiens
  misc_feature: GYAE6OF02GNUH8.25.86.H09.1.454.CMB.1.raw
  modified_base (413)..(416): a, c, t, g, unknown or other
  misc_feature (413)..(416): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtcttccccctggcgccctgctccaggagcacctccgagagcacagcggcctgggctgcctggtcaaggactacttccactgtacagtctgagcgggctggcaaggcgcatagnnnn

SEQ ID NO: 19876 - DNA, 506 bp, Homo sapiens
  misc_feature: GYAE6OF02HKRTW.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtccatcaagttcagcgcagtggatctgggacagatttcatcctcaccatcagcagcctgcagcctgaagattctgccaaccttattattgtacaactaatttaaggactttaccctctcttccgttcggcgacgggacctaagggtcggagtataccgaaagactggtgtcgtcgcacctacg

SEQ ID NO: 19877 - DNA, 514 bp, Homo sapiens
  misc_feature: GYAE6OF02G89NQ.25.86.H09.1.454.CMB.1.raw
  modified_base (279)..(279): a, c, t, g, unknown or other
  misc_feature (279)..(279): n is a, c, g, or t
  modified_base (405)..(405): a, c, t, g, unknown or other
  misc_feature (405)..(405): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtcccatcaaggttcagcggcaggtggatcgtgggacagtatttcatcctcaccatcagcagcctgcagcctagaagtattcngacaaccttattattgtacaaactaatttaacgtacttaccctacttccttccgttacggcggacggaccgaagggtaggagactacgaacgacgtggtgctgcactac

SEQ ID NO: 19878 - DNA, 417 bp, Homo sapiens
  misc_feature: GYAE6OF02I58CD.25.86.H09.1.454.CMB.1.raw
  modified_base (218)..(218): a, c, t, g, unknown or other
  misc_feature (218)..(218): n is a, c, g, or t
  modified_base (409)..(417): a, c, t, g, unknown or other
  misc_feature (409)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggactacggtcatcgtctcctcagcctcaccaagggcccatcggtcttccccctggcgccctgctccaggagcacctccgagagcacagcggccctgggctgcctggcaaggctactccactgacagtctgagcgggctggcaaggcgcatagnnnnnnnnn

SEQ ID NO: 19879 - DNA, 517 bp, Homo sapiens
  misc_feature: GYAE6OF02HQ0XX.25.86.H09.1.454.CMB.1.raw
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccagggaagctcctaagctacctgatctttgatgcctcagtttggaagtggagtccatcaaggttcagcgcagtggatctgggacagatttcatccncaccatcagcagcctgacagcctagaagnttctgcctaaaccttattacttcgtacaaactaaagttttaacggattacccctctacctaccgttcggacggtagggaccaagggtcgagacttacaaacgtactggcgactgccactacg

SEQ ID NO: 19880 - DNA, 524 bp, Homo sapiens
  misc_feature: GYAE6OF02HIE60.25.86.H09.1.454.CMB.1.raw
  modified_base (439)..(439): a, c, t, g, unknown or other
  misc_feature (439)..(439): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtataagcagaaaccaggggaagctctaagctcctgatctttgatgcctccagtttggaaagtggagtcccatcaaggttcagcgcagtggatctgggacagatttcatcctcacatcagcagcctgcagcctagaagtattctgactaaccgtatttatgtacaaactaatttaagatttaccctnttcctccgttcggcggtaacgggaccagggtacggaggaactaccgtaaaacgaacgttgtaggctggacctaccattctgtacc

SEQ ID NO: 19881 - DNA, 456 bp, Homo sapiens
  misc_feature: GYAE6OF02FGYYV.25.86.H09.1.454.CMB.1.raw
  modified_base (345)..(345): a, c, t, g, unknown or other
  misc_feature (345)..(345): n is a, c, g, or t
  modified_base (423)..(425): a, c, t, g, unknown or other
  misc_feature (423)..(425): n is a, c, g, or t
  modified_base (427)..(456): a, c, t, g, unknown or other
  misc_feature (427)..(456): n is a, c, g, or t
tcagactgtacagtcacgaccggtgctcgatttagtgctatagacttgggtttgggaggaagaacctactatgcagactctgtgaagggtcggattcaccacctccagagacaacatcaagaactccctgtatctgcaaatggaccagtctggacaccctgatgacaccgccttgtattattgtgtgaaaggcggtgttgaggtgaatgcctggaacccccgcggtcagcactacttctacatgggcgtctggggcaaaggggctacggtcatcgtctcctcagcctccaccaagggcccatcggtcttccccctggccgccctgctccaggagcacctccgagngcgacagcggccctgggctgccctggtcaaggactacttccactgacagtctgaggcgggctggcaaggcgacatagnnnannnnnnnnnnnnnnnnnnnnnnnnnnnnnn

SEQ ID NO: 19882 - DNA, 422 bp, Homo sapiens
  misc_feature: GYAE6OF02HEEEW.25.86.H09.1.454.CMB.1.raw
  modified_base (218)..(218): a, c, t, g, unknown or other
  misc_feature (218)..(218): n is a, c, g, or t
  modified_base (414)..(422): a, c, t, g, unknown or other
  misc_feature (414)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaagggactacggtcatcgtctcctcagcctccaccaagggccccatcggtcttccccctggccgccctgctccaggacgcacctccgagagcacagcggccctgggctgcctggtcaagctactccactgtacagtctgagcgggctggcaaggcgcatagnnnnnnnnn

SEQ ID NO: 19883 - DNA, 580 bp, Homo sapiens
  misc_feature: GYAE6OF02FVALM.25.86.H09.1.454.CMB.1.raw
tcagactgtacagtcacgaccggtgctcgatttagtgctatagacttgggtttgggggggagtcagacccactcaggacacagcatggacatgagggtccccgctcagctcctgggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaacgctacctaaagcctacctgattctttgatgcctcagtttaggaagtggagtccatcaaggtcagcgcagtgatcgtggacagtactttcactcctcacctatcagcagcctgcacgcctgaagtacttctgacctaaccttatttacttgtacaaactaagtttaacgactttaacccgttctaccttacccgtttcgggaccggggtacgggtacccgtaagggtcgggaacgtaacgtaacccggaaaaccggtaccgttcggtacggtccttacggaccccaaccgtacttaccttacg

SEQ ID NO: 19884 - DNA, 565 bp, Homo sapiens
  misc_feature: GYAE6OF02GJF3F.25.86.H09.1.454.CMB.1.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagtatttcacttcctcaccatcagcacgcctgcagcctagaagtattctagacctaaccttatttacttcgtacaaactaagttttaaggactttacccttcttccttcccgttcgggaccgggtaacgggtaccgtaagggtcgggaacgtaacgttaccgaaaacggtacgttaggtacggtacgttcgaccacccgtattcgttacg

SEQ ID NO: 19885 - DNA, 422 bp, Homo sapiens
  misc_feature: GYAE6OF02GQDYD.25.86.H09.1.454.CMB.1.raw
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (413)..(422): a, c, t, g, unknown or other
  misc_feature (413)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggcccatcggtcttcccctggcgccctgctccnggagcacctccgagagcacagcggccctgggctgcctggtcaaggctacttccactgtacngtctgagcgggctggcaaggcgcatagnnnnnnnnnn

SEQ ID NO: 19886 - DNA, 527 bp, Homo sapiens
  misc_feature: GYAE6OF02F4QXG.25.86.H09.1.454.CMB.1.raw
  modified_base (446)..(446): a, c, t, g, unknown or other
  misc_feature (446)..(446): n is a, c, g, or t
tcagactgtacagtcacgaccggtgctcgatttagtgctatagacttgggtttggggggacacctggggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcagacccactcaggacacagcatggacatgagggtccccgctcagctccgtggggcttctgctgctctggcctcccaggtcgccaaatgtgccatccagttcgacccagtctccatcctcatgtctgcctctgttcgagacatacgtccacatctacttgtcgggtcttaggtcgggtctagttggctagtgtctttagccttggtatcgagcaagaaaccgaggggaacnctaccgtaagccttacgtgtacttcttagactcgtccttaccgtaggtttacggaaaggttcggtacgttcccagtaccgg

SEQ ID NO: 19887 - DNA, 417 bp, Homo sapiens
  misc_feature: GYAE6OF02HHXW5.25.86.H09.1.454.CMB.1.raw
  modified_base (218)..(218): a, c, t, g, unknown or other
  misc_feature (218)..(218): n is a, c, g, or t
  modified_base (415)..(417): a, c, t, g, unknown or other
  misc_feature (415)..(417): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaggggactacggtcatcgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnnn

SEQ ID NO: 19888 - DNA, 519 bp, Homo sapiens
  misc_feature: GYAE6OF02GNVNK.25.86.H09.1.454.CMB.1.raw
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaagctcctaagctcctgatcttgatgcctcagttggaagtggagtccatcaagttcagcgcagtgatcgtggacagtatttcatcctcaccatcagaancctgcagcctagaagnttcngactaaccttattattcgactaactaagttttaaggactttaccctcttctccgttcgggcggacgggtacctaagggtggagtactacgaaacgtaactggtcggcttacggcctaccgtatcg

SEQ ID NO: 19889 - DNA, 541 bp, Homo sapiens
  misc_feature: GYAE6OF02I7SYP.25.86.H09.1.454.CMB.1.raw
  modified_base (480)..(480): a, c, t, g, unknown or other
  misc_feature (480)..(480): n is a, c, g, or t
  modified_base (484)..(491): a, c, t, g, unknown or other
  misc_feature (484)..(491): n is a, c, g, or t
  modified_base (493)..(494): a, c, t, g, unknown or other
  misc_feature (493)..(494): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(521): a, c, t, g, unknown or other
  misc_feature (520)..(521): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagactgtacagtcacgaccggtgctcgatttagtgctatagacttgggtttgggagggaagaacctactatgcagactctgtgaagggtcgattcaccacctccagagacaacatcaagaactccctgtatctgcaaatggacagtctggacacctgatgacaccgccttgtacttattgtgtgaaaggcggtgttgaggtgaatgcctggaacccccgcggtcagcactacttctacatgggcgtctggggctaaagggctacggtcatcgtctcctcacgcctccaccaacgggcccatcggtcttcccctggccgccctgactcccgacggtacgccgtacctccgagacgtccacacggccggcccgtcgggcctggccctgggtccaaacggtacctaccgttcccaacgttcgtaccaggttccctggaggcccggggtctagggaccgaaagggccgtactaacgttaggntcgnnnnnnnnannagntgtgngngngngngngngngngnngcngcgcncncnncgcncnc

SEQ ID NO: 19890 - DNA, 638 bp, Homo sapiens
  misc_feature: GYAE6OF02I7L7S.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctacctaagctcctgactctttgatgcctcagtttggaaagtggacgtcccatcaaggttcacggcggctaggtggatcgtagggacaggtcttttcacgttcctacacctatcagcagcctagccagtccgtagaacgtactttccgtacgacctaaacctttagtttactttacgttaacctaaactttaaacgttttaacggttaaccttttaaccccgttactttacccgtttacccgttaccggggaccggggttaaccgggaaccccgttaaggggttaccggaacggtaaccgttaccggaaaacgttaccgttgggtaccggtaccggttacgacccgtacccgttaacgg

SEQ ID NO: 19891 - DNA, 423 bp, Homo sapiens
  misc_feature: GYAE6OF02HHESH.25.86.H09.1.454.CMB.1.raw
  modified_base (414)..(414): a, c, t, g, unknown or other
  misc_feature (414)..(414): n is a, c, g, or t
  modified_base (420)..(423): a, c, t, g, unknown or other
  misc_feature (420)..(423): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggccccatccggtcttccccctggccgccctgcctccaggacgcaccctccgagagcacacgcggccctgggcctgcctggtcaaggctacttcactgtacagtctgagcgggctggcaaggcncatagnnnn

SEQ ID NO: 19892 - DNA, 446 bp, Homo sapiens
  misc_feature: GYAE6OF02G0420.25.86.H09.1.454.CMB.1.raw
  modified_base (401)..(401): a, c, t, g, unknown or other
  misc_feature (401)..(401): n is a, c, g, or t
  modified_base (432)..(446): a, c, t, g, unknown or other
  misc_feature (432)..(446): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggactacggtcatcgtctcctcagccctccaccaagggcccatcggtccttccccctggccgccctgcctccagggacgccacctccgagacgcacacgcggccctgggcctgccgtggtacaaggactacgttccactgtacngtctgaggcgggctgggcaaggcgacatagnnnnnnnnnnnnnnn

SEQ ID NO: 19893 - DNA, 503 bp, Homo sapiens
  misc_feature: GYAE6OF02FYP5D.25.86.H09.1.454.CMB.1.raw
  modified_base (472)..(503): a, c, t, g, unknown or other
  misc_feature (472)..(503): n is a, c, g, or t
tcagactgtacagtcacgaccggtgctcgatttagtgctatagacttgggtttggggagaagaacctactatgccagactctgttgaagggtcgtattcaccacctccagagacaacatcaagaactccctgtatctgcaaatggacagtctgactacctgatgactaccgccttgtattattgtgtgaaaggcggtgttgaggtgaagtgcctggaacccccgcggtccaggccactacttctacatgggcgtctggggcaaagggactacggtcatcgtctcctcagccctccaccaagggccccagtccggtccttccccccgtggccgcccgtggcctccgagggacgccaccctccggagacgcacgaggccgggccctggggcctggcccctgggtccaaagggtaccttaccgttcccgacgttcgtaccagtcctgacggcgggctgggcaagggccgcatagnnnnnnnnnnnnnnnnnnnnnnnnnnnnnnnn

SEQ ID NO: 19894 - DNA, 624 bp, Homo sapiens
  misc_feature: GYAE6OF02IT6BY.25.86.H09.1.454.CMB.1.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcggctagtcggtcattggcagtgctttagcctggtatcagcaagaaaccgaggggtaagctacctaaagctcctgattctttgatcgcctcagtttaggaaagtgactccatcgaagtcagcgnagtgatcgtggganagatttcgatcctcacagtcagcacgctgccgagtcctagaaagtactttaccgcgtacctaaaccctttatttaacgtttacgttaacctaaaacgttaaagtttttaaaccgggtaaccttttaaccccttcttacccggttcccgtttaccggggaccggggttaacgggacccggtaaaggggtcggtaacgtaaccggttaacgaaaaacccggtaaccgttcgggtacggaccgttacggaccctaacccgttaacgg

SEQ ID NO: 19895 - DNA, 520 bp, Homo sapiens
  misc_feature: GYAE6OF02FTCSG.25.86.H09.1.454.CMB.1.raw
  modified_base (394)..(394): a, c, t, g, unknown or other
  misc_feature (394)..(394): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagttgaagtgagtccatcaggttcagcggcagtggatcgtgggacagatttcatcctcaccatcagcagcctgcagcctgaagattcngcaaccttattacttagtcaaactaatttaacggactttaccctcttccttcccgttacggcggacgggtaccgaagggtggaacgtactaccgaaacgtacgttggtaggcttggaccacctacg

SEQ ID NO: 19896 - DNA, 425 bp, Homo sapiens
  misc_feature: GYAE6OF02IRV8U.25.86.H09.1.454.CMB.1.raw
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (408)..(408): a, c, t, g, unknown or other
  misc_feature (408)..(408): n is a, c, g, or t
  modified_base (414)..(425): a, c, t, g, unknown or other
  misc_feature (414)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtagaaaggcggtgttgaggtgaatgcctggaaccccnggtcagcactacttctacatgggcgtctggggacaaaggggctacggtcatcgtctcctcagcctccaccaagggcccctatccggcttccccnggcnccctgcctccaagngcacctcganagcacngtcgcctgggctgcctggtacaaggctacttcaactgtacagtctgagcggctggaacaggcntatagnnnnnnnnnnnn

SEQ ID NO: 19897 - DNA, 424 bp, Homo sapiens
  misc_feature: GYAE6OF02FQ4PV.25.86.H09.1.454.CMB.1.raw
  modified_base (310)..(310): a, c, t, g, unknown or other
  misc_feature (310)..(310): n is a, c, g, or t
  modified_base (417)..(424): a, c, t, g, unknown or other
  misc_feature (417)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtcttcccccnggccgccctgcctccaggagcacctccgagacgcacagcggccctgggctgcctggtcaaggctacttccactgtacagtctgagcgggctgggcaaggcgcatagnnnnnnnn

SEQ ID NO: 19898 - DNA, 602 bp, Homo sapiens
  misc_feature: GYAE6OF02IWMX0.25.86.H09.1.454.CMB.1.raw
  modified_base (403)..(403): a, c, t, g, unknown or other
  misc_feature (403)..(403): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaacgctacctaagctcctgactctttgatgcctcagtttggaagttggacgtccatcgaagttcagcgcaggtgatcgtgggacagtatttcatctcaccatcagcagctgcacgcctgaaacgtnttccgtagacctaaccgttactttagttacgttaaccaaacgtttaaagttttaaacggtacctttaaccccttacgttacccgtttacccgttacgggacccgggtaagggtaacccgtaaacggggttaggaacgtaacgttaaccgaaaacggtaaccgttcggttacggtaccttacggtacccgtacttaaccg

SEQ ID NO: 19899 - DNA, 647 bp, Homo sapiens
  misc_feature: GYAE6OF02J2IBX.25.86.H09.1.454.CMB.1.raw
  modified_base (220)..(220): a, c, t, g, unknown or other
  misc_feature (220)..(220): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
tcagactgtacagtcacgaccggtgctcgatttagtgctatagacttgggtttgggagaagaacctactatcgcagactctcgtgaagggtcgattcaccacctccagagacaacatcaagaactccctgtatctgcaaatggacagtactgacaccctgactgacaccgccttgtattatgtgtgaaaggcgtgttgaggtgaatgccgtggaccccgnggtcagtcactactctacatgggctcgtgggacaagggactacggtcatcgtctcctcacgtcctaccaccgaacgggccctacgtccggtccttacccccgtggccgtcccgtcggccgttccgaaggacgtaccgacccgttacccggaacgacgaccgaacgaccggtccggtccccgtggggaccttcgggcccgtacggtaccgaaacgggtaccctttaaccgttccctacgttcgtaaccacgttccgtcgggtaacggtccgggtacgtacgggaccgaaacggtccggactaacgtacggntcacgagtcgacgntacgngacgacgagacgacgacgcgtacgtcgtcgtcgacgtacgacgtacgtcgtactacgtacgtacgtagtacgtacgtacgtagtactacgtacgtacg

SEQ ID NO: 19900 - DNA, 593 bp, Homo sapiens
  misc_feature: GYAE6OF02GWS86.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctacctaagctcctgatctttgatgcctcagtttggaaagtggacgtcccatcaaggttcagcggcagtggatctgggacaggtactttcgatcctcacctatcagcagccctgccagcctagaagtattcgtcgacctaaaccgtttatttactttagtacctaaacgtaaagtttttaacggaacttttaccccgtacttccttacccgtttccggggacgggtaacgggtaacccgtaaagggggttcggaaggtaactaaccgaaaacggtaacgttcgggtacggtaccgttcggacccgtacctaacg

SEQ ID NO: 19901 - DNA, 425 bp, Homo sapiens
  misc_feature: GYAE6OF02F67C3.25.86.H09.1.454.CMB.1.raw
  modified_base (419)..(425): a, c, t, g, unknown or other
  misc_feature (419)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggactacggtcatcgtctcctcagcctccaccaagggcccatccggtcttccccctggccgccctgctccaggacgccacctccgagagcacagcggccctgggctgcctggtcaaggctactccactgtacagtctgagcgggctggcaaggcgcagtagnnnnnnn

SEQ ID NO: 19902 - DNA, 564 bp, Homo sapiens
  misc_feature: GYAE6OF02HCBOW.25.86.H09.1.454.CMB.1.raw
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagttggaagtggagtccatcagttcagcgnagtgatctggacagtatttcactcctcaccatcgagcacgcctgcagcctagaagtcttcgagactaaccttattattcgtactaaacttaagtttaacggtactttaccctcttcccgttccgtttaccgggcggtaacggggtaacccgtaaggggttacgggaaacgtacgttaaccgaaaacggtaccgttacggtacggaccgttcggaccctaaccctacg

SEQ ID NO: 19903 - DNA, 639 bp, Homo sapiens
  misc_feature: GYAE6OF02H218U.25.86.H09.1.454.CMB.1.raw
  modified_base (359)..(359): a, c, t, g, unknown or other
  misc_feature (359)..(359): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggcttagtcgggtcattggcagtgctttagcctggtatcagcagaaaccaggggaagctcctaagcctcctgattctttgatgcctcagtttggaagtggatccatcaaggttcagcggcaggtgatcgtgggacngtatttcatcctcaccatcagcacgcctgcgagccttgaagtattctagaccaaaccttatttaacgttagttacctaaacgttaaacttttaaacgggttaacctttaaccccgttacttacccgtttacccgtttaccgggtacccggggtaaccggggtaaccccggtaaagggggttaccggggtaaacggtaacgtttaaacccggtaaaaaccggttaaccgtttaacggggttacgggtacccgttacggtaccccgtaacccgttaacccgg

SEQ ID NO: 19904 - DNA, 469 bp, Homo sapiens
  misc_feature: GYAE6OF02G9MK6.25.86.H09.1.454.CMB.1.raw
  modified_base (225)..(225): a, c, t, g, unknown or other
  misc_feature (225)..(225): n is a, c, g, or t
  modified_base (433)..(435): a, c, t, g, unknown or other
  misc_feature (433)..(435): n is a, c, g, or t
  modified_base (437)..(469): a, c, t, g, unknown or other
  misc_feature (437)..(469): n is a, c, g, or t
tcagactgtacagtcacgaccggtgctcgatttagtgctatagacttgggggttgggagaaggaacctactatgcagacgtctgtgaagggtcgattcaccgacctccagagacaacatccaagaactccctgtatctgcgaaatgggaccagtctgacacctgatgacaccgccttgtattattgtgtgaaaggcgtgttgaggtgaatgcctggaacccccgnggtcagccactacttctacatgggcgtctaggggcaaagggactacggtcatcgtctcctcagcctccaccaagggcccatcggtcttcccctggcgccctgctccaggacgcaccgttccgagacggcacagcgggccctggggactgcctggtcaagggcctacttccactgtacagtctgagcgggctgggacaaggcgcatagnnngnnnnnnnnnnnnnnnnnnnnnnnnnnnnnnnnn

SEQ ID NO: 19905 - DNA, 591 bp, Homo sapiens
  misc_feature: GYAE6OF02F5XYI.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggacgtccatcaaggttcagcggcagtggatcgtgggacagatttcatcctcaccatacagcagcctgccagtccgtagaagtactttctacgtacctaaacctttaattacttacgtacaaactaatttaaggtactttaaccccgtcttccttcccggttaccgggaccgggtaacgggtaacccggtaagggttacgggtaacggtaacgttaacccgaaaacggtaacttacgggttacggtaccgtcggtacccgtaaccctaaccg

SEQ ID NO: 19906 - DNA, 636 bp, Homo sapiens
  misc_feature: GYAE6OF02HIWQU.25.86.H09.1.454.CMB.1.raw
  modified_base (283)..(283): a, c, t, g, unknown or other
  misc_feature (283)..(283): n is a, c, g, or t
  modified_base (342)..(342): a, c, t, g, unknown or other
  misc_feature (342)..(342): n is a, c, g, or t
tcagactgtacagtcacgaccggtgctcgatttagtgctatagacttggggtttgggggcaggagtccagacccactcaggacacagcatggacactgagggtccccgctcagctcctggggcttctgctgctctggctcccaggtgccaaatgtgccatccgagttgacccagtctccatcctccctgtctgcctctgttcgagacatagtcaccgatcacgttgtcggctaggtcggtcattggcagtgctttagcctgtatcagacagaaccaggggaanctactaagctcgtgatctttgatcgcctcagttggaagtggagtccatcaagtcagcgnagtgatcgtaggacagtatttacactcctacaccatacgacgcaacgtccgtgacgacgtaccgtagtaaacgtacgttccgacgtacctaaaccttaagtttacgtttaccgttaaccgtaaaacgttaaagttttaaacggtaaccttttaaccccgtcgttacccgttaccgtttccgggtaccgggtaacggttaaccccggtaaagggttcgggaaaacgtaccgttaaccgaaaaccggttaccggtaggggttaccgtacccggttacggtaccctaaccgttacgg

SEQ ID NO: 19907 - DNA, 573 bp, Homo sapiens
  misc_feature: GYAE6OF02HX8FE.25.86.H09.1.454.CMB.1.raw
tcagactgtacagtcacgaccggtgctcgatttagtgctatagacttgggtttgggggggacacctggggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcagacccatcaggacacagcatggacatgaggtcccgctcagctcctggggcttctgctgctctggctcccaggtgccaaatgtgccatccagttcgacccagtcctccactcctccctgtctcgcctctgttcgagacatacgtcaccatctacttgtcggctagtcgggtctagttggctgtcgtcgtttacgccgtaggtatcacgacgaacgaaaccgaacggggaacgtaccgtaccgtaaacgtcctacccgtgtacgtttcgtttgaacttcggtacccttacccggtaaggttttacgggaaaacggttcgggtaaccggttaccccgtagttaaccgttaaaccgggg

SEQ ID NO: 19908 - DNA, 428 bp, Homo sapiens
  misc_feature: GYAE6OF02IVWPD.25.86.H09.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (422)..(428): a, c, t, g, unknown or other
  misc_feature (422)..(428): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgnggtcagcactacttctacatgggctcgtggggcaaagggactacggtcatcgtctcctcagccctcaccaagggcccatcggtctcccctggcgcccngctccagagcacctccgagacgcacagcgcccgtgggctgcctggtcaaaggactacttaccactcgtacagtcctgacggcgggtctgggcgtaaggcgcactagnnnnnnn

SEQ ID NO: 19909 - DNA, 438 bp, Homo sapiens
  misc_feature: GYAE6OF02GK4D9.25.86.H09.1.454.CMB.1.raw
  modified_base (218)..(218): a, c, t, g, unknown or other
  misc_feature (218)..(218): n is a, c, g, or t
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
  modified_base (428)..(438): a, c, t, g, unknown or other
  misc_feature (428)..(438): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaggggactacggtcatcgtctcctcagccctccaccaaggggccccagtcggtccttcccccgtggccgccctgcctccaggganccactccggagagcacagccggccctgggctgccctaggtcaaggtactacttccactgtacagtctgagcggctggccaaggcnatagnnnnnnnnnnn

SEQ ID NO: 19910 - DNA, 555 bp, Homo sapiens
  misc_feature: GYAE6OF02F6F7G.25.86.H09.1.454.CMB.1.raw
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
  modified_base (416)..(416): a, c, t, g, unknown or other
  misc_feature (416)..(416): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggatcccatcaaggttcagcggcagtggatcgtgggacagatttcatccncacatcagcagcctgccagcctagaagtnttcctgcctaaaccttnttattgtacaactaagtttaagactttaccctcttctccgttacgggcggtaacggggaccctaaagggtcggaacgtaagttacccgaaaaacggtaccgttgggttacggtccgttacggaccctaacccgttaacg

SEQ ID NO: 19911 - DNA, 464 bp, Homo sapiens
  misc_feature: GYAE6OF02JYQPM.25.86.H09.1.454.CMB.1.raw
  modified_base (217)..(217): a, c, t, g, unknown or other
  misc_feature (217)..(217): n is a, c, g, or t
  modified_base (450)..(464): a, c, t, g, unknown or other
  misc_feature (450)..(464): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaaggggactacggtcatcgtctcctcagcctccaccaagggccccatccggtccttccccctggccgccctgcctcccaggacgccacctccgagacgccacacggccggccctggggcctcggccctgggtacaacgggtaccttaaccttccacgttcgtaccagtcctggacggcgggctggcaaggcgcatagnnnnnnnnnnnnnnn

SEQ ID NO: 19912 - DNA, 524 bp, Homo sapiens
  misc_feature: GYAE6OF02JJ4JI.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggggaanctcctaagcctcctgatctttgatcgcctcagtttggaagtgagtccatcaaggttcagcggcaggtgatcgtgggacagtatttcatcctcaccatcagcagcctgcacgcctagaagtcttctgacctaaccttattagttcgtactaactaaatttaacggactttaccctcttctaccgttcggacggacggaccgtaaggtggagtactacgaaacgactcggtcggactacgcacctacg

SEQ ID NO: 19913 - DNA, 538 bp, Homo sapiens
  misc_feature: GYAE6OF02GDPYY.25.86.H09.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (327)..(327): a, c, t, g, unknown or other
  misc_feature (327)..(327): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (517)..(517): a, c, t, g, unknown or other
  misc_feature (517)..(517): n is a, c, g, or t
  modified_base (526)..(538): a, c, t, g, unknown or other
  misc_feature (526)..(538): n is a, c, g, or t
tcagactgtacagtcacgaccggtgctcgatttagtgctatagacttggggtttgggaggaacgaacctactatgcagactctgtgaacgggtcgattcaccaccgtcccgagagacgaacatcaagaactccctgtatctgacaaactggacaggtactagacacctgatgacaccgcttgtattactgtgtgaaacgcgtnttgaggtnaatgcctaggaacccccgggtcacgcacgtacttcacattgggctcgtggggacaaaaggggctacggtcatcgtctcctcagccctccaccaagggcccatccggtcttccccgnggcgccctgctccaggagcacctcgagagccacacgacggccgtgggcctggccctggtacaaagggtaccgttacgttccgacgtcggtaacgacgtactggacggtcgggctgggaccgaacgggcgacgacgtccgngtcngcncgtcnccgtcncgtcgactctacgcgcgcgcgcggcgacgcgnacgacgcgnnnnnnnnnnnnn

SEQ ID NO: 19914 - DNA, 635 bp, Homo sapiens
  misc_feature: GYAE6OF02FLW2B.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtccatcaaggttcagcggcagtggatcgtgggacagtatttcatccctcaccatcagcagcctgcagccttagaagtacttctacgacctaaaccttatttaacttcggttaacctaaaacttaaagtttttaaacgggtaccttttaacccccttactttaccgttaccccggttttaccggggaccggggtaaacgggggtaacccgtaaaagggggttcgggtaaaccggtaacgtttaacccgaaaaaaccgggttaacccgttagggttacggggtaccctttacgggacccctaacccgttaacg

SEQ ID NO: 19915 - DNA, 599 bp, Homo sapiens
  misc_feature: GYAE6OF02JYDSU.25.86.H09.1.454.CMB.1.raw
  modified_base (380)..(380): a, c, t, g, unknown or other
  misc_feature (380)..(380): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagcctcctgatctttgatgcctcctagtttggaaaggtggagtcccatcgaaggttcaggcggcgaggtggagtcgtgggacagtacccctttnactcctacacctatcagcagcctgcgacgccttagaagtattcgtgtacctaaccttaattattacgtactaaacttaaagtttaacggtaacctttacccgttacttaccgttaccgtttaccgggtacgggtaacgggtacccggtaaagggttacggaagtaacgttaacgaaacggtaacgttacggtacggtacgtacggtaccgtaccgtacg

SEQ ID NO: 19916 - DNA, 578 bp, Homo sapiens
  misc_feature: GYAE6OF02IB3N6.25.86.H09.1.454.CMB.1.raw
  modified_base (286)..(286): a, c, t, g, unknown or other
  misc_feature (286)..(286): n is a, c, g, or t
  modified_base (424)..(424): a, c, t, g, unknown or other
  misc_feature (424)..(424): n is a, c, g, or t
tcagactgtacagtcacgaccggtgctcgatttagtgctatagacttggggtttgggggcaggagtcagacccactcaggacacagcatggacatcgagggtccccgctcagctcctggggcttctgctgctctggctcccaggtgccaaatgtgccatccagttgacccagtctccatccctccctgtctgccttctgttcgagacatagtcaccatcacttgtcgggctaggtcgggtcattggctagtgctttagcctggtatcagcagaaaccgagggaacnctacctaagctcctgtatctttgatcgtccttcgtaggttttaggaaagtggtacgtccatcgtaaggttcaggcgtcgagtgatcgtgggtacagtatttcgactcctcacatcagtcagcctgcagcctagaagtnttccgtagacctaaccgttattacgttaatacgtaaacttaagtttaacgtactttccctactccgttaccgtccggacgggtacgggaccgtaagggtcgtaacggaacttaaccgaacggtacgtacggtcggtactcggaccctagtaccg

SEQ ID NO: 19917 - DNA, 455 bp, Homo sapiens
  misc_feature: GYAE6OF02FZXGJ.25.86.H09.1.454.CMB.1.raw
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
  modified_base (432)..(455): a, c, t, g, unknown or other
  misc_feature (432)..(455): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggcccatcggtcttccccctggccgccctgctccaggagcacctccgagagcacngccggcccgtgggctcgcgtcggtacaaggtacctacttcccactcgtacagtcctggacggcgggctgggcaagggcncagtagnnnnnnnnnnnnnnnnnnnnnnnn

SEQ ID NO: 19918 - DNA, 546 bp, Homo sapiens
  misc_feature: GYAE6OF02H8NRC.25.86.H09.1.454.CMB.1.raw
  modified_base (492)..(492): a, c, t, g, unknown or other
  misc_feature (492)..(492): n is a, c, g, or t
  modified_base (523)..(523): a, c, t, g, unknown or other
  misc_feature (523)..(523): n is a, c, g, or t
tcagactgtacagtcacgaccggtgctcgatttagtgctatagacttgggtttgggggcaggagtcagacccactcaggacacagcatggacatgagggtccccgctcagctcctgggactcctgctgctctggctcccagataccagatgtgacgtccagatgacccagtctccatcctcctgtctgcatctgttgagacagaatcagcatcacttgccgggacagtccagggcattagcaattattagcctggtactcaaacagaaccgagggagagttacctaagtcgtcctgatctatgctcgcctccacgttaccacgtcgacgggtcccatccgtcgttcagtcgcagtcaatcgtaggacagtagttcaccttctacgacttactacagtcacgtccgagccgtacgccttagaagactttgggtactaacttacgtttacttaacgttgttaacgtaaagttaactaactaccgtccgcccttnttccgtacgtttcggacggacggacgtaggngagattaccgaagtacagttgac

SEQ ID NO: 19919 - DNA, 420 bp, Homo sapiens
  misc_feature: GYAE6OF02GJ75D.25.86.H09.1.454.CMB.1.raw
  modified_base (384)..(384): a, c, t, g, unknown or other
  misc_feature (384)..(384): n is a, c, g, or t
  modified_base (412)..(420): a, c, t, g, unknown or other
  misc_feature (412)..(420): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaagtggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaagggcccatcggtcttccccctggcgccctgctccaggagcacctccgagagcacagcggccctgggctgcctggtcaaggctacttccactgtacngtctgagcgggctggcaaggcgcatagnnnnnnnnn

SEQ ID NO: 19920 - DNA, 582 bp, Homo sapiens
  misc_feature: GYAE6OF02IWEXY.25.86.H09.1.454.CMB.1.raw
  modified_base (279)..(279): a, c, t, g, unknown or other
  misc_feature (279)..(279): n is a, c, g, or t
  modified_base (342)..(342): a, c, t, g, unknown or other
  misc_feature (342)..(342): n is a, c, g, or t
  modified_base (471)..(471): a, c, t, g, unknown or other
  misc_feature (471)..(471): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctacctaagctctgatctttgatgcctctaggtttggaagtggatccatcaaggttcagcggnaggtggatcgtaggacagtatttcacttcctacacctatcagcagcctgccagccgttagaacgtattcctacgacctaaaccttatttacttcgtaactaaactaaagttttaacgacttttaccccncttcgttccgttacgggccggaacggggtaaccctaagggggttcggaaacgtacgttaacccgtaaaaccggtacgttcggttaccggcgttacggaccctaaccgtacg

SEQ ID NO: 19921 - DNA, 429 bp, Homo sapiens
  misc_feature: GYAE6OF02ICRR5.25.86.H09.1.454.CMB.1.raw
  modified_base (218)..(218): a, c, t, g, unknown or other
  misc_feature (218)..(218): n is a, c, g, or t
  modified_base (418)..(429): a, c, t, g, unknown or other
  misc_feature (418)..(429): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaggggctacggtcatcgtctcctcagcctccaccaagggcccatccggtccttccccctggccgccctgcctccaggacaacctccgagagcacagccggccctgggctgcctggtcaaggctactccactgtacagtctgagcgggctggcaaggcgcagtagnnnnnnnnnnnn

SEQ ID NO: 19922 - DNA, 619 bp, Homo sapiens
  misc_feature: GYAE6OF02J2LRN.25.86.H09.1.454.CMB.1.raw
  modified_base (284)..(284): a, c, t, g, unknown or other
  misc_feature (284)..(284): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctcctgtctgcctctgttcgagacatagtcaccatcacttgtcgggctaggtcgggtcagttggcagtgctttagcctggtatcagcaagaaaccgaggggaacnctacctaagcctcctgatctttgatcgcctcctaggtttaggaaagtggacgtccatcaaggttcagtcggcaggtggtatcgtaggggacaggtatttcactcctacaccgtatccaggtcacgtccctagcctagacctaggaacgtacttccgagtacctaaccttattacttacgtactaaacttaaagtttaacggttaccttaaccccttcgttaccttccgtttaccgggacgggtaccgggtaacccgtaaaggggtcggtaaacgtactaaaccggtaaaccgtaacggttacgggtacggttcgtaaccggtcctaaccgttacg

SEQ ID NO: 19923 - DNA, 602 bp, Homo sapiens
  misc_feature: GYAE6OF02FOKAX.25.86.H09.1.454.CMB.1.raw
  modified_base (128)..(128): a, c, t, g, unknown or other
  misc_feature (128)..(128): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagactgtacagtcacgaccggtgctcgattagtgctatagacttgggtttgggagaagacctactatgcagactctgtgaagggtcgattcaccacctccagagacacatcacgacctccctgtanctgcaatggacagtctgaccacctgatcgaccacccgtccttagtattagttgtgtaggaaacggtcggttgttgacgtgaactcgcccgtcgacccccgcggtcncnccnctacctcnccgngtcgggtcgtcggtcggccgaacggggacctacgcnctccgtctccncgaccgccctacccgaccgccggtccctccgttcccgtccgtctcgtgtcgcgcctcggacgccgaccgacccgcgacgcgaccgtaccgccggtccgcccggtcgggtaccgtccggtcccgtaccggtaccgaccgggtaaccctttacccgtacccgtacgtacgtaccgtaccgggttaccgcgggaccggtccggtacggtaccggaccggaacggcgtaacgacctgccncncncncnncncncncncnncncgncncncncncncncncncncncncncncnncncncncncncngc

SEQ ID NO: 19924 - DNA, 518 bp, Homo sapiens
  misc_feature: GYAE6OF02GNKHA.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtcccatcaaggttcagcggcaggtggatcgtgggacagtactttcatcctcaccatcagcagcctgcagcctagaacgtacttctagcctaaccttattacttgtactaactaatttaaggactttacctctccttccttcggacggaggaccgaagggtggagtatacaaacgactggtggctagccactacg

SEQ ID NO: 19925 - DNA, 601 bp, Homo sapiens
  misc_feature: GYAE6OF02JB24T.25.86.H09.1.454.CMB.1.raw
  modified_base (406)..(406): a, c, t, g, unknown or other
  misc_feature (406)..(406): n is a, c, g, or t
  modified_base (463)..(463): a, c, t, g, unknown or other
  misc_feature (463)..(463): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggagctctaagctcctgatctttgatgcctcctagtttggaaagtggagtcccatcaaggttcagcggcaggtggatcgtgggacagtatttcatcctacacatcagcagcctgcagcctagaaagtcttcngacctaaccttattaacttgtaccaaacttaagttttaacggacttttaaccccgtnttaccgttacccgtttacggggacccgggtaaggggtaacccgtaaagggggttacggaaacggtaaccgttaaccgaaaaaccggtaaccggttacgggttaccgggaccgtttacggtacccgaacccgttaacgg

SEQ ID NO: 19926 - DNA, 566 bp, Homo sapiens
  misc_feature: GYAE6OF02H17M3.25.86.H09.1.454.CMB.1.raw
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaccaggggaacgctcctaagcctcctgatctttgatgcctcagtttaggaagtggagtccatcgaaggttcagcggacaggtggatcgngggacagtatttcatccctcaccatcagcagcctgcagcctaggaagtacttcgngaaccaaccgttattacgttagtaacctaaacttaaagtttaacggtaacctttacccctcttccttacccgtttacgggaccgggtaacgggaaccgtaaagggtgaagtaactaacgaaacgtacgtggtacggcttacggacctactacg

SEQ ID NO: 19927 - DNA, 446 bp, Homo sapiens
  misc_feature: GYAE6OF02IBCWK.25.86.H09.1.454.CMB.1.raw
  modified_base (218)..(218): a, c, t, g, unknown or other
  misc_feature (218)..(218): n is a, c, g, or t
  modified_base (433)..(446): a, c, t, g, unknown or other
  misc_feature (433)..(446): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctggggcaaaagggactacgggtcatcgtctcctcagcctccaccaagggcccatccggtccttccccctggccgcccctgcctccgaggacgcacctccgagacgcacagccggcctgggcctgcctggtacaaggtactactccactgtacagtctgaggcgggctgggacgaagggcgacagtagnnnnnnnnnnnnnn

SEQ ID NO: 19928 - DNA, 567 bp, Homo sapiens
  misc_feature: GYAE6OF02HGKCR.25.86.H09.1.454.CMB.1.raw
  modified_base (411)..(411): a, c, t, g, unknown or other
  misc_feature (411)..(411): n is a, c, g, or t
  modified_base (559)..(559): a, c, t, g, unknown or other
  misc_feature (559)..(559): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggacgtcccatcaaggttcagcggcagtggatcgtggggacagtatttcgacttcctccaaccatccaaggcaggccctgcacgcctagaagtnttctgacctaacctattattcgtacaaacttaagtttaacggactttacccgtcttccgtcccgttacgggacggtaacggggtaccctaagggtcgggaagtaacgttacgaaaacggtacgttaggtcggacgtgaccctaacctntcgttccg

SEQ ID NO: 19929 - DNA, 613 bp, Homo sapiens
  misc_feature: GYAE6OF02FYOM1.25.86.H09.1.454.CMB.1.raw
  modified_base (279)..(279): a, c, t, g, unknown or other
  misc_feature (279)..(279): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgtctttagcctggtatcagcaagaaaccgaggggaanctactaagctcctgattcttgatcgcctctaggtttaggaagtcggatcccatacgaggttcagcggcgagtggactcgtaggacagtacgttcactccctcaccatcaagcacgtcctgaccacgtaccgtagaacgttagttcctacgaacctaacctttagtttaacttacgtactaaacttaagttttaaacgtacctttacccttacgttccgttacccggttacgggaaccgggacgggtaccgtaaacggggtggtaaacggtaacgtaaccggaaacgttaacggtgggttacggtaccgtacgaccgtaccgtagttccgttacg

SEQ ID NO: 19930 - DNA, 614 bp, Homo sapiens
  misc_feature: GYAE6OF02HNDTL.25.86.H09.1.454.CMB.1.raw
  modified_base (282)..(282): a, c, t, g, unknown or other
  misc_feature (282)..(282): n is a, c, g, or t
tcagactgtacagtcacgaccggtgctcgatttagtgctatagacttgagctctgggaaaggagccccagccctgagattcccaggtgattccattcggtgatcagcactgaacacagaactcaccatggagtttggactgagctgggttttccttgttgccatttttaaaaggtgtccagtgtgaagtgcaactggtggagtcgtgggggagccgtggtacagccgggggggtccctgagactctcctgtgtagcctctggattcattgtttgatgattangccatgcactgggtccgtcgaaggtccggggaagggtcgtgggaggtgggtctctcttatgtacgttgggagtggggagaagaacctactatgcagactctgtgaagggtcattccaccacctccgagagaaccaacatacaaagaaccttccctgtacttctgactaaagtggactagttctagaccaccgtagacgtacgacctacccgtcctttaggttaactttagttcgtaggttacgggtaaacggggtcggtttaggtttaggacgggttaggtaacgttcggaccccggttaccgggtaaccccccggtcgggttaccaaccgg

SEQ ID NO: 19931 - DNA, 427 bp, Homo sapiens
  misc_feature: GYAE6OF02GB8EG.25.86.H09.1.454.CMB.1.raw
  modified_base (419)..(427): a, c, t, g, unknown or other
  misc_feature (419)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagccctccaccaagggcccatccggtccttccccctggccgccctgcctccgaggagccacctccgagagcacagcggccctgggctgcctggtcaaggctactccactgtacagtctgagcgggctggcaaggcgcatagnnnnnnnnn

SEQ ID NO: 19932 - DNA, 430 bp, Homo sapiens
  misc_feature: GYAE6OF02I75N9.25.86.H09.1.454.CMB.1.raw
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (419)..(430): a, c, t, g, unknown or other
  misc_feature (419)..(430): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaaggcggtgttgaggtgaatgcctggaacccccgcggtcagcactacttctacatggggctctgggggcaaaggggactacggtcatcgtctcctcagcctccaccaagggcccatcggtcctccccctggccgccctgctccaggacgcacctccgagacgcacagccggcctcgggctcgcctggtcaagactactccactgtacngtctgagcggctggcaagggcnactagnnnnnnnnnnnn

SEQ ID NO: 19933 - DNA, 422 bp, Homo sapiens
  misc_feature: GYAE6OF02GBBF1.25.86.H09.1.454.CMB.1.raw
  modified_base (327)..(327): a, c, t, g, unknown or other
  misc_feature (327)..(327): n is a, c, g, or t
  modified_base (409)..(409): a, c, t, g, unknown or other
  misc_feature (409)..(409): n is a, c, g, or t
  modified_base (415)..(422): a, c, t, g, unknown or other
  misc_feature (415)..(422): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcagcctccaccaaggcccatcggtcttccccctggcgccctgctccaggancacctcgagagcacagcgccctgggctgcctggtcaaggactacgttccactcgtacagtctgtagcgggctggcaagggcncatagnnnnnnnn

SEQ ID NO: 19934 - DNA, 552 bp, Homo sapiens
  misc_feature: GYAE6OF02JZSGZ.25.86.H09.1.454.CMB.1.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (531)..(531): a, c, t, g, unknown or other
  misc_feature (531)..(531): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatnagcagaaaccgaggggaanctcctaagctcctgatcttgatcgcctctagtttggaaagtggacgtccatacaaggttcagtcgcaggtgagtcngggacagtcttcactctcacntcancagctgcagctgaatcgttcagtacctaacttattacttacgactaaacgtaagttttaacggtaactttacccttcttccttccgtaccgggacgggtaacggtaccgaaggttggaacgtacgtaacgaaacgacgttaggcggtacncgactaccgtattccgttacg

SEQ ID NO: 19935 - DNA, 554 bp, Homo sapiens
  misc_feature: GYAE6OF02GPLYH.25.86.H09.1.454.CMB.1.raw
  modified_base (548)..(548): a, c, t, g, unknown or other
  misc_feature (548)..(548): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacagccgggggggtccctgagactctcctgtgtagcctctggattcatgtttgatgattatgccatgcactgggtccgtcaaggtccgggggaagggtctgggagtgggtctctcttatgacttgggatgggagaagaacctactatgacagactctgtggaaggtcattcaccacctccagagacaacatacaaagaacctccctgtactctagacaaagtggacagtcctagaccacctgatcgaaccaccgtccttagttattattgtgtaggtaaggtcggttagttgaggtgaagtcgaccgtacggacccccggngtaccg

SEQ ID NO: 19936 - DNA, 600 bp, Homo sapiens
  misc_feature: GYAE6OF02FS2YY.25.86.H09.1.454.CMB.1.raw
tcagactgtacagtcacgaccggtgctcgatttagtgctatagacttgggtttgggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaacgctcctaagcctcctgattctttgatcgtcctcctaggtttaggaaaggtggtacgtcccatcgaaggttcagcggcaggtggatcgtagggacagtatttcactcctacaccatcagcacgcctgcacgcctagaagtacttctacgacctaaaccttatttacttcgttaacctaaacttaacgttttaacggtacctttacccttacttccgttacccggtttacgggaccgggtacgggacccgtaagggtacgggtaacgtaacgttaaccgaaaccggtacgttggtacggctacgacctaccgtactcgttacg

SEQ ID NO: 19937 - DNA, 423 bp, Homo sapiens
  misc_feature: GYAE6OF02GFBPN.25.86.H09.1.454.CMB.1.raw
  modified_base (218)..(218): a, c, t, g, unknown or other
  misc_feature (218)..(218): n is a, c, g, or t
  modified_base (409)..(409): a, c, t, g, unknown or other
  misc_feature (409)..(409): n is a, c, g, or t
  modified_base (415)..(423): a, c, t, g, unknown or other
  misc_feature (415)..(423): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggctctggggcaaagggactacggtcatcgtctcctcagcctccaccaagggccccatcggtccttcccctggccgccctgctccaggacgcacctcgagagcacagcggccctgggctgcctggtcaaggactacttccactgtacagtctgagcgggctggcaaggcncatagnnnnnnnnn

SEQ ID NO: 19938 - DNA, 575 bp, Homo sapiens
  misc_feature: GYAE6OF02HBJ53.25.86.H09.1.454.CMB.1.raw
  modified_base (284)..(284): a, c, t, g, unknown or other
  misc_feature (284)..(284): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcgggctaggtcgggtcagttggcagtgctttagcctggtatcagcagaaaccgaggggaacnctcctaagctcctgattctttgatgcctcgtaggtttaggaaagtggacgtcccatcaaggttcagcggcagtggatcgtgggactagtactttcactcctacaccatcgagccacgcctgccacgcctagaacgtacttctcgacctaaccttattagttacgtactaacttaagtttaacggtactttacccttctcgttacccgttcgggacgggtacggtaccgtaagggtcggaacgtacgttaacgaaacgtacgttcggtacggtacgtacgacctaccgtacg

SEQ ID NO: 19939 - DNA, 589 bp, Homo sapiens
  misc_feature: GYAE6OF02GTOHD.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctttctgcctctgttcgagacatagtcaccatcacttgcgggctaggtcggtcattggcagtgctttagccttggtatcagcagaaaccgaggggaanctacctaagctcctgattcttgatgtcctcctagtttggaagtggacgtcccatctaaggttcaggcggctagtgatcgtgggacagtagtttcactcctcaccatcagacagtccgtgacacgcctaggaacgtcttcgtagacctaacctttattattacgtaacctaaacgttaagtttaaacggtacttttaacccctcgttaccttcccgtttcgggacggtacgggtaccgtaaggggtccgaagtaacgtaacgtaaaccggtacgttacggtacggtcctacggacctaccgtacttaccg

SEQ ID NO: 19940 - DNA, 713 bp, Homo sapiens
  misc_feature: GYAE6OF02H9WPQ.25.86.H09.1.454.CMB.1.raw
  modified_base (236)..(236): a, c, t, g, unknown or other
  misc_feature (236)..(236): n is a, c, g, or t
  modified_base (699)..(699): a, c, t, g, unknown or other
  misc_feature (699)..(699): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctaggtcgggtntagttggacagtgtctttacgccgtggtatcagacaacgaaaccggaggggaacgtactacctaagtcctaccgtgtacgttctttgactcgtccttaccgtagtttagggaaaggtggacgtaccgaactacgtaacggttcgacggcggtagtacgtagggtacgtacggtacgggaacgtaggttatttaccgtacttcccgaccctaactacgtccgaacggtctaaccgccgttacgccgtaacggaccttaggtaacgttactttcgacgtaaccctaaccgttttatttaaacggtttacctaaaccgttaaactttaaacggtttaaccgttaaccctttccccttaccttaccgttacccgggttaccgggtaaccgggtaaccggggtaacccgtaaaggggtacggtaactaaccgttaaccgtaacgtaacgtcgggtacgtaccgttacncccgtaacttaccg

SEQ ID NO: 19941 - DNA, 554 bp, Homo sapiens
  misc_feature: GYAE6OF02GKN6B.25.86.H09.1.454.CMB.1.raw
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatctttgatgcctcagtttggaagtggacgtcccatcgaaggttcagcgggcaggtggatcgtggggacaggtatttcattcccacaccatcagcagccctgccagcctagaacgtcttcngacctaaccttatttattcgtacaacttaagtttaacggactttaccctcttccttccgttcgggacggtacgggaccgtaagggtcggaagacgttaaccgaaacgtaacggttcgtagggcctcggacccacgtacg

SEQ ID NO: 19942 - DNA, 682 bp, Homo sapiens
  misc_feature: GYAE6OF02G7VFW.25.86.H09.1.454.CMB.1.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccggaggactctacgactcctcgtatcttcgtatagtccgtcctacgttaggttaaggtaaggtcggtaccgtacctacgtaacggttacgtacgacggcgacgtaggtacgtacgtcgggtacggaacgtagttacctttactaccttcccgtaccaactactacgacgaccgtaccgtccgtagaccgtccgtacgtaaggtaactttcgttccgtacgtaacccttaaacgtttaactttacgttacgtaaaccttaaacgtttaaaggttaaccgttaccctttaccctccgtttacccgttacccgggtacgggacggggtaacccggtaacggtaacggggtacgaacgtaacgtaaaccggaaacggttacgttcggtaccgtaccgtccgtaccctacgttaccg

SEQ ID NO: 19943 - DNA, 600 bp, Homo sapiens
  misc_feature: GYAE6OF02JGD60.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggacnctacctaagctacctgatcttgatcgcctcctagtttggaaagtggacgtccagtcaaggttcagcggcagtggatcgaggacagtatttcacgtcctcacctatcagcacggccttgacctacgcctaggtaatacttcgtcgtaacctaaccctttagtttacgttacgtacctaaaactttaaggtttaacgtaaccttttaccctacgttaccgttccgttaccgggacgggtaacgggtaaccgtaaggggttacggtaacggtaacttaacccggtaaacgtacgttggtacgaccgtagtacccacgttaccg

SEQ ID NO: 19944 - DNA, 564 bp, Homo sapiens
  misc_feature: GYAE6OF02H3LSV.25.86.H09.1.454.CMB.1.raw
  modified_base (276)..(276): a, c, t, g, unknown or other
  misc_feature (276)..(276): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatcttgatgcctcagtttggaaagtggactcccatcaaggttcagcggcagtgatctgggacagtatttcattccctnacctatcacgtcagcctgcaggccttagaacgtatttcngactaaccttattattacgtactaaacttaagttttaacggactttaccctacttccttacgttccgggtacggacgggtaccgtaaagggtcggaagtacttacgaaaaccggttaacgtcggtacggtacctacggactacccgtattccttacgg

SEQ ID NO: 19945 - DNA, 556 bp, Homo sapiens
  misc_feature: GYAE6OF02I1BYJ.25.86.H09.1.454.CMB.1.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctacctaagctcctgatctttgatcgcctccgagttttggaaagtggacgtccatacgaaggttcagcggcaggtggatcgtgggacagtatttcatcctcaccatcagcacgcctgcacgcctagaagtacttcgtcgacctaaccttattaacttcgtactaaactaaagttttaacggacctttaccctcttccgttccgttacgggcggtaacgggaccgaagggttacggaagtactaacgaaacgtacgtggtacggctacgccactacg

SEQ ID NO: 19946 - DNA, 427 bp, Homo sapiens
  misc_feature: GYAE6OF02JB30C.25.86.H09.1.454.CMB.1.raw
  modified_base (218)..(218): a, c, t, g, unknown or other
  misc_feature (218)..(218): n is a, c, g, or t
  modified_base (420)..(427): a, c, t, g, unknown or other
  misc_feature (420)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggactacggtcatcgtctcctcagcctccaccaagggcccatcggtcttccccctggcgccctgctccaggagcacctccgagacgcacagccggccctgggctgcctggtcaaggactacttccactcgtacagtctgagcgggctgggcaggcgcagtagnnnnnnnn

SEQ ID NO: 19947 - DNA, 681 bp, Homo sapiens
  misc_feature: GYAE6OF02F4UZZ.25.86.H09.1.454.CMB.1.raw
tcagactgtacagtcacgaccggtgctcgatttagtgctatagacttagggtttgggggcaagggacgtacagaccccactcgaggacaccagcatggacatgagggtccccgctcgaggctcctggggcttctgtcttgctctggctcccaggtgccgaaatcgtgcccagttccagtttggacccagtctccagtcctccctgtctgcctctgttacgacgacgactagtcaccatcgacttcgtcgggctaggtcgggtctattggcagtgtctttagccttggtatctagtcaagaaaccgaggggaacgctacgtaagctccgtgattcgttgatgcctcgtaggtttaggaaagtacggacgtccctatcgaaggttcaggtcggacgaggtggatcgtagggacaggtactttaccgacgttaccctacaaccgtactaccgagtaccgacgtccctagaccgtacggaccttaggaaacgttctttacccgaggaccttaaaccctttatttacgttacggtaaccctaaaaccgttaaacgttttaacggtactttaaccccgttcgttacccgttacccggtttacgggacggtaacgggtaacccgtaaggggtcgtaacgtacgtaccgtaaacggtacttcgggtacggacgttacgaccgtactacg

SEQ ID NO: 19948 - DNA, 435 bp, Homo sapiens
  misc_feature: GYAE6OF02HBQ24.25.86.H09.1.454.CMB.1.raw
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (424)..(435): a, c, t, g, unknown or other
  misc_feature (424)..(435): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaagggactacggtcatcgtctcctcacgcctccaccaacgggccccatccggtccttccccctggccgccctgcctccaggcgcacctccgagacgcacacgcggccctgggctgccctggtcaaggactacttccactgtacngtctgagcgggctggcaaggcncatagnnnnnnnnnnnn

SEQ ID NO: 19949 - DNA, 548 bp, Homo sapiens
  misc_feature: GYAE6OF02FWI0E.25.86.H09.1.454.CMB.1.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagcctggtatcagcagaaaccaggggaanctctaagctcctgatctttgatcgcctcagtttggaagtggacgtcccatcgaagttcagcgcagtgatcgtggacagtatttcatcctcaccatcagcagcctgcagcctagaagtactttcagacctaaaccttatttattcgtactaaacttaagtttaacggactttaccctcttacgttacccgttcgggacggaacgggtaaccgtaagggtggaacgtataaccgaaacgtacgttggtaccggactacggacctaccgtacg

SEQ ID NO: 19950 - DNA, 592 bp, Homo sapiens
  misc_feature: GYAE6OF02HQCK6.25.86.H09.1.454.CMB.1.raw
  modified_base (428)..(428): a, c, t, g, unknown or other
  misc_feature (428)..(428): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagcaagaaaccgaggggaagctacctaagcctccgtgattctttgatcgccttctagtttaggaagtggagtccatcgaagttcagcgcaggtgatcgtgggacagtactttcattcctacacctatcagcacgtcctgaccagtcccttaggaacgtactttcgngtacctaaaccttagtttaacttacgtaactaaacgttaaattttaacggaccttttaacccctcttaccgttccgttaccggggcgggtaacgggaaccgtaagggtcggaaacgtaacgtaacgaaacgtacgttgggtacgtcgtacggacctaaccgtac
